United States Patent 11,805,774 (SEED TREATMENT METHODS AND COMPOSITIONS FOR IMPROVING PLANT TRAITS AND YIELD) - sequence listing, part 5

SEQ ID NO: 7770 - DNA, 1523 bp, Rhodococcus sp. KBW08; identical to SEQ ID NO: 7769
  ref <308>: DATABASE ACCESSION NUMBER: NCBI ACCESSION: NZ_QAJJ01000020.1
  ref <309>: DATABASE ENTRY DATE: 2019-04-01
  ref <313>: RELEVANT RESIDUES IN SEQ ID NO: (1)..(1523)

SEQ ID NO: 7771 - DNA, 1526 bp, Rhodococcus sp. LHW50502
  ref <308>: DATABASE ACCESSION NUMBER: NCBI ACCESSION: NZ_RKLN01000011.1
  ref <309>: DATABASE ENTRY DATE: 2019-04-01
  ref <313>: RELEVANT RESIDUES IN SEQ ID NO: (1)..(1526)
ttcaacggagagtttgatcctggctcaggacgaacgctggcggcgtgcttaacacatgcaagtcgagcggtaaggccccttcgggggtacacgagcggcgaacgggtgagtaacacgtgggtgatctgccctgcactctgggataagcccgggaaactgggtctaataccggataggaccgcgcatcgcatggtgtgtggtggaaagggtttactggtgcaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggccaactacgtgccagcagccgcggtaatacgtagggtgcgagcgttgtccggaattactgggcgtaaagagctcgtaggcggtttgtcgcgtcgtctgtgaaaacccgcagctcaactgcgggcttgcaggcgatacgggcagactcgagtactgcaggggagactggaattcctggtgtagcggtgaaatgcgcagatatcaggaggaacaccggtggcgaaggcgggtctctgggcagtaactgacgctgaggagcgaaagcgtgggtagcgaacaggattagataccctggtagtccacgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatgtaccggaaacacccagagatgggtgcccccttgtggtcggtatacaggtggtgcatggctgtcgtcagctcgtgtcgtgagatgttgggttaagtcccgcaacgagcgcaacccttgtcctgtgttgccagcgcgtaatggcggggactcgcaggagactgccggggtcaactcggaggaaggtggggacgacgtcaagtcatcatgccccttatgtccagggcttcacacatgctacaatggccggtacagagggctgcgatgccgtgaggtggagcgaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcccaacccctcggggagggagccgtcgaaggtgggatcggcgattgggacgaagtcgtaacaaggtagccgtaccggaaggtgcggctggatcacctcctttctaa

SEQ ID NO: 7772 - DNA, 1526 bp, Rhodococcus sp. LHW51113
  ref <308>: DATABASE ACCESSION NUMBER: NCBI ACCESSION: NZ_RKLO01000010.1
  ref <309>: DATABASE ENTRY DATE: 2019-04-01
  ref <313>: RELEVANT RESIDUES IN SEQ ID NO: (1)..(1526)
ttcaacggagagtttgatcctggctcaggacgaacgctggcggcgtgcttaacacatgcaagtcgagcggtaaggctccttcgggggtacacgagcggcgaacgggtgagtaacacgtgggtgatctgccctgcactctgggataagcccgggaaactgggtctaataccggataggaccgcgcatcgcatggtgtgtggtggaaagggtttactggtgcaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcgagtgacggtacctgcagaagaagcaccggccaactacgtgccagcagccgcggtaatacgtagggtgcgagcgttgtccggaattactgggcgtaaagagctcgtaggcggtttgtcgcgtcgtctgtgaaaacccgcagctcaactgcgggcttgcaggcgatacgggcagactagagtactgcaggggagactggaattcctggtgtagcggtgaaatgcgcagatatcaggaggaacaccggtggcgaaggcgggtctctgggcagtaactgacgctgaggagcgaaagcgtgggtagcgaacaggattagataccctggtagtccacgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatgtaccggaaacacccagagatgggtgcccccttgtggtcggtatacaggtggtgcatggctgtcgtcagctcgtgtcgtgagatgttgggttaagtcccgcaacgagcgcaacccttgtcctgtgttgccagcgcgtaatggcggggactcgcaggagactgccggggtcaactcggaggaaggtggggatgacgtcaagtcatcatgccccttatgtccagggcttcacacatgctacaatggctggtacagagggctgcgatgccgtgaggtggagcgaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcccaacccctcggggagggagccgtcgaaggtgggatcggcgattgggacgaagtcgtaacaaggtagccgtaccggaaggtgcggctggatcacctcctttctaa

SEQ ID NO: 7773 - DNA, 1523 bp, Rhodococcus sp. NJ-530; identical to SEQ ID NO: 7769
  ref <308>: DATABASE ACCESSION NUMBER: NCBI ACCESSION: NZ_CP034152.1
  ref <309>: DATABASE ENTRY DATE: 2019-04-01
  ref <313>: RELEVANT RESIDUES IN SEQ ID NO: (1)..(1523)

SEQ ID NO: 7774 - DNA, 1523 bp, Rhodococcus sp. OK269
  ref <308>: DATABASE ACCESSION NUMBER: NCBI ACCESSION: NZ_QTTW01000021.1
  ref <309>: DATABASE ENTRY DATE: 2019-04-01
  ref <313>: RELEVANT RESIDUES IN SEQ ID NO: (1)..(1523)
ttttacggagagtttgatcctggctcaggacgaacgctggcggcgtgcttaacacatgcaagtcgagcggtaaggcctttcggggtacacgagcggcgaacgggtgagtaacacgtgggtgatctgccctgcactctgggataagcctgggaaactgggtctaataccggatatgaccatgggatgcatgtttcatggtggaaagcttttgtggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcggaagcctgatgcagcgacgccgcgtgagggatgaaggccttcgggttgtaaacctctttcagcagggacgaagcgtgagtgacggtacctgcagaagaagcaccggctaactacgtgccagcagccgcggtaatacgtagggtgcgagcgttgtccggaattactgggcgtaaagagttcgtaggcggtttgtcgcgtcgtttgtgaaaacccggggctcaacttcgggcttgcaggcgatacgggcagacttgagtgtttcaggggagactggaattcctggtgtagcggtgaaatgcgcagatatcaggaggaacaccggtggcgaaggcgggtctctgggaaacaactgacgctgaggaacgaaagcgtgggtagcaaacaggattagataccctggtagtccacgccgtaaacggtgggcgctaggtgtgggttccttccacgggatctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatacaccggaaagctgcagagatgtagccccccttgtggtcggtgtacaggtggtgcatggctgtcgtcagctcgtgtcgtgagatgttgggttaagtcccgcaacgagcgcaacccttgtcttatgttgccagcgcgttatggcggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtagccgtaccggaaggtgcggctggatcacctcctttctaa

SEQ ID NO: 7775 - DNA, 1523 bp, Rhodococcus sp. OK551; identical to SEQ ID NO: 7763
  ref <308>: DATABASE ACCESSION NUMBER: NCBI ACCESSION: NZ_QUNE01000041.1
  ref <309>: DATABASE ENTRY DATE: 2019-04-01
  ref <313>: RELEVANT RESIDUES IN SEQ ID NO: (1)..(1523)

SEQ ID NO: 7776 - DNA, 1523 bp, Rhodococcus sp. P1Y
  ref <308>: DATABASE ACCESSION NUMBER: NCBI ACCESSION: NZ_CP032762.1
  ref <309>: DATABASE ENTRY DATE: 2019-04-01
  ref <313>: RELEVANT RESIDUES IN SEQ ID NO: (1)..(1523)
ttttacggagagtttgatcctggctcaggacgaacgctggcggcgtgcttaacacatgcaagtcgagcggtaaggcctttcggggtacacgagcggcgaacgggtgagtaacacgtgggtgatctgccctgcactctgggataagcctgggaaactgggtctaataccggatatgaccgcatgatgcatgttgtgtggtggaaagcttttgtggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcggaagcctgatgcagcgacgccgcgtgagggatgaaggccttcgggttgtaaacctctttcagcagggacgaagcgtgagtgacggtacctgcagaagaagcaccggctaactacgtgccagcagccgcggtaatacgtagggtgcgagcgttgtccggaattactgggcgtaaagagttcgtaggcggtttgtcgcgtcgtttgtgaaaacccggggctcaacttcgggcttgcaggcgatacgggcagacttgagtgtttcaggggagactggaattcctggtgtagcggtgaaatgcgcagatatcaggaggaacaccggtggcgaaggcgggtctctgggaaacaactgacgctgaggaacgaaagcgtgggtagcaaacaggattagataccctggtagtccacgccgtaaacggtgggcgctaggtgtgggttccttccacgggatctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatacaccggaaagccgtagagatacggccccccttgtggtcggtgtacaggtggtgcatggctgtcgtcagctcgtgtcgtgagatgttgggttaagtcccgcaacgagcgcaacccttgtcttatgttgccagcgcgttatggcggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtagccgtaccggaaggtgcggctggatcacctcctttctaa

SEQ ID NO: 7777 - DNA, 1527 bp, Rhodococcus sp. Q1
  ref <308>: DATABASE ACCESSION NUMBER: NCBI ACCESSION: NZ_SDMJ01000019.1
  ref <309>: DATABASE ENTRY DATE: 2019-04-01
  ref <313>: RELEVANT RESIDUES IN SEQ ID NO: (1)..(1527)
ttcaacggagagtttgatcctggctcaggacgaacgctggcggcgtgcttaacacatgcaagtcgaacgatgaagcccagcttgctgggtggattagtggcgaacgggtgagtaacacgtgggtgatctgccctgcactctgggataagcctgggaaactgggtctaataccggataggaccttcggccgcatggctgggggtggaaagtttttcggtgcaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcacccatgacgaagcgcaagtgacggtagtgggagaagaagcaccggccaactacgtgccagcagccgcggtaatacgtagggtgcgagcgttgtccggaattactgggcgtaaagagctcgtaggcggtttgtcgcgtcgtctgtgaaaacccgcagctcaactgcgggcttgcaggcgatacgggcagactcgagtactgcaggggagactggaattcctggtgtagcggtgaaatgcgcagatatcaggaggaacaccggtggcgaaggcgggtctctgggcagtaactgacgctgaggagcgaaagcgtgggtagcgaacaggattagataccctggtagtccacgccgtaaacggtgggcgctaggtgtgggtttccttccacgggatccgtgccgtagccaacgcattaagcgccccgcctggggagtacggccgcaaggctaaaactcaaaggaattgacgggggcccgcacaagcggcggagcatgtggattaattcgatgcaacgcgaagaaccttacctgggtttgacatgtaccggacgactgcagagatgtggtttcccttgtggccggtagacaggtggtgcatggctgtcgtcagctcgtgtcgtgagatgttgggttaagtcccgcaacgagcgcaacccttgtcctgtgttgccagcacgtaatggtggggactcgcaggagactgccggggtcaactcggaggaaggtggggacgacgtcaagtcatcatgccccttatgtccagggcttcacacatgctacaatggtcggtacagagggctgcgataccgtgaggtggagcgaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaacccctcgtgggagggagccgtcgaaggtgggatcggcgattgggacgaagtcgtaacaaggtagccgtaccggaaggtgcggctggatcacctcctttctaa

SEQ ID NO: 7778 - DNA, 1523 bp, Rhodococcus sp. SBT000017
  ref <308>: DATABASE ACCESSION NUMBER: NCBI ACCESSION: NZ_REFU01000003.1
  ref <309>: DATABASE ENTRY DATE: 2019-04-01
  ref <313>: RELEVANT RESIDUES IN SEQ ID NO: (1)..(1523)
ttttacggagagtttgatcctggctcaggacgaacgctggcggcgtgcttaacacatgcaagtcgagcggtaaggcctttcggggtacacgagcggcgaacgggtgagtaacacgtgggtgatctgccctgcactctgggataagcttgggaaactgggtctaataccggatatgactgcatgccgcatggtgtgtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcggaagcctgatgcagcgacgccgcgtgagggatgaaggccttcgggttgtaaacctctttcagcagggacgaagcgtgagtgacggtacctgcagaagaagcaccggctaactacgtgccagcagccgcggtaatacgtagggtgcgagcgttgtccggaattactgggcgtaaagagttcgtaggcggtttgtcgcgtcgtttgtgaaaacccggggctcaacttcgggcttgcaggcgatacgggcagacttgagtgtttcaggggagactggaattcctggtgtagcggtgaaatgcgcagatatcaggaggaacaccggtggcgaaggcgggtctctgggaaacaactgacgctgaggaacgaaagcgtgggtagcaaacaggattagataccctggtagtccacgccgtaaacggtgggcgctaggtgtgggttccttccacggaatctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatacaccggaaaaccgtagagatacggtcccccttgtggtcggtgtacaggtggtgcatggctgtcgtcagctcgtgtcgtgagatgttgggttaagtcccgcaacgagcgcaacccttgtcttatgttgccagcgcgttatggcggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagccgtcgaaggtgggatcggcgattgggacgaagtcgtaacaaggtagccgtaccggaaggtgcggctggatcacctcctttctaa

SEQ ID NO: 7779 - DNA, 1520 bp, Rhodococcus sp. X156
  ref <308>: DATABASE ACCESSION NUMBER: NCBI ACCESSION: NZ_CP034766.1
  ref <309>: DATABASE ENTRY DATE: 2019-04-01
  ref <313>: RELEVANT RESIDUES IN SEQ ID NO: (1)..(1520)
acggagagtttgatcctggctcaggacgaacgctggcggcgtgcttaacacatgcaagtcgagcggtaaggcccttcggggtacacgagcggcgaacgggtgagtaacacgtgggtgacctgcccttcactctgggataagccttggaaacgaggtctaataccggatatgacctcctgctgcatggtggggggtggaaagcgtttagtggtgaaggatggacccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcacctgtgacgaagcgaaagtgacggtagcaggagaagaagcaccggccaactacgtgccagcagccgcggtaatacgtagggtgcaagcgttgtccggaattactgggcgtaaagagctcgtaggcggtttgtcgcgtcgtctgtgaaaactcatggctcaaccatgagcttgcaggcgatacgggcagacttgagtattgcaggggagactggaattcctggtgtagcggtgaaatgcgcagatatcaggaggaacaccggtggcgaaggcgggtctctgggcaaatactgacgctgaggagcgaaagcatgggtagcaaacaggattagataccctggtagtccatgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatacactggaaacacctagagataggtgccccgcaaggtcggtgtacaggtggtgcatggctgtcgtcagctcgtgtcgtgagatgttgggttaagtcccgcaacgagcgcaacccttgtcttatgttgccagcacgtaatggtggggactcgtaagagactgccggggtcaactcggaggaaggtggggacgacgtcaagtcatcatgccccttatgtccagggcttcacacatgctacaatggccggtacagagggctgctaagccgcgaggtggagcgaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggtaacacccgaagccagtggcccaaccccttgtgggagggagctgtcgaaggtgggatcggcgattgggacgaagtcgtaacaaggtagccgtaccggaaggtgcggctggatcacctcctttctaa

SEQ ID NO: 7780 - DNA, 1539 bp, Rhodocyclaceae bacterium
  ref <308>: DATABASE ACCESSION NUMBER: NCBI ACCESSION: NZ_CP020026.1
  ref <309>: DATABASE ENTRY DATE: 2019-04-01
  ref <313>: RELEVANT RESIDUES IN SEQ ID NO: (1)..(1539)
tgaacttaagagtttgatcctggctcagattgaacgctggcggcatgctttacacatgcaagtcgaacggcagcgggggcttcggcctgccggcgagtggcgaacgggtgagtaatgcatcggaacgtacccagtggtgggggatagctcggcgaaagccggattaataccgcatacgccctgagggggaaagtgggggatcttcggacctcacgccattggagcggccgatgtcggattagctagttggtgaggtaaaggctcaccaaggcgacgatccgtagctggtctgagaggatgatcagccacactgggactgagacacggcccagactcctacgggaggcagcagtggggaattttggacaatgggcgcaagcctgatccagccatgccgcgtgagtgaagaaggccttcgggttgtaaagctctttcagtcgggaagaaaaggcgggctctaacatagcctgttgctgacggtaccgacagaagaagcaccggctaactacgtgccagcagccgcggtaatacgtagggtgcgagcgttaatcggaattactgggcgtaaagcgtgcgcaggcggtttgctaagacaggtgtgaaatccccgggcttaacctgggaactgcgcttgtgactggcaggctagagtacggcagaggggggtggaattccacgtgtagcagtgaaatgcgtagagatgtggaggaacaccgatggcgaaggcagccccctgggcctgtactgacgctcatgcacgaaagcgtggggagcaaacaggattagataccctggtagtccacgccctaaacgatgtcaactagtcgttcggagcggtaacgcactgagtgacgcagctaacgcgtgaagttgaccgcctggggagtacggccgcaaggttaaaactcaaaggaattgacggggacccgcacaagcggtggatgatgtggattaattcgatgcaacgcgaaaaaccttacctacccttgacatgccaggaatcttggtgagagccgagagtgccttcgggagcctggacacaggtgctgcatggctgtcgtcagctcgtgtcgtgagatgttgggttaagtcccgcaacgagcgcaacccttgccactaattgccatcattgagttgggcactttagtgggactgccggtgacaaaccggaggaaggtggggatgacgtcaagtcctcatggcccttatgggtagggcttcacacgtcatacaatggtcggtacagagggttgccaagccgcgaggcggagccaatccctacaaagccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggtttcaccagaagtaggtagcttaaccttcgggagggcgcttaccacggtgagattcatgactggggtgaagtcgtaacaaggtagccgtatcggaaggtgcggctggatcacctcctttc

SEQ ID NO: 7781 - DNA, 1545 bp, Rhodoferax ferrireducens
  ref <308>: DATABASE ACCESSION NUMBER: NCBI ACCESSION: NC_007908.1
  ref <309>: DATABASE ENTRY DATE: 2019-04-01
  ref <313>: RELEVANT RESIDUES IN SEQ ID NO: (1)..(1545)
agatcgaactatagagtttgatcctggctcagattgaacgctggcggcatgccttacacatgcaagtcgaacggcagcacgggagcaatcctggtggcgagtggcgaacgggtgagtaatatatcggaacgtgcccagtcgtgggggataacgcagcgaaagctgtgctaataccgcatacgatctctggatgaaagcgggggactcgcaagggcctcgcgcgattggagcggccgatatcagattagctagttggtggggtaaaagcccaccaaggcgacgatctgtagctggtctgagaggacgaccagccacactggaactgagacacggtccagactcctacgggaggcagcagtggggaattttggacaatgggcgcaagcctgatccagcaatgccgcgtgcaggatgaaggccttcgggttgtaaactgcttttgtacggaacgaaacggcctgccctaatacggtgggctaatgacggtaccgtaagaataagcaccggctaactacgtgccagcagccgcggtaatacgtagggtgcgagcgttaatcggaattactgggcgtaaagcgtgcgcaggcggttatataagacagatgtgaaatccccgggctcaacctgggacctgcatttgtgactgtatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagagccgtaacacaggtgctgcatggctgtcgtcagctcgtgtcgtgagatgttgggttaagtcccgcaacgagcgcaacccttgtcattagttgctacatttagttgggcactctaatgagactgccggtgacaagccggaggaaggtggggatgacgtcaagtcctcatggcccttataggtggggctacacacgtcatacaatggctggtacaaagggttgccaacccgcgagggggagctaatcccacaaagccagtcgtagtccggatcgtagtctgcaactcgactacgtgaagtcggaatcgctagtaatcgtggatcagaatgtcacggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctg

SEQ ID NO: 7782 - DNA, 1543 bp, Rhodoferax sp. IMCC26218
  ref <308>: DATABASE ACCESSION NUMBER: NCBI ACCESSION: NZ_QFZK01000050.1
  ref <309>: DATABASE ENTRY DATE: 2019-04-01
  ref <313>: RELEVANT RESIDUES IN SEQ ID NO: (1)..(1543)
agatcgaactatagagtttgatcctggctcagattgaacgctggcggcatgccttacacatgcaagtcgaacggcagcacgggagcaatcctggtggcgagtggcgaacgggtgagtaatatatcggaacgtgcccagtcgtgggggataacgcagcgaaagctgtgctaataccgcatacgatctatggatgaaagcgggggatcgcaagacctcgcgcgattggagcggccgatatcagattagctagttggtggggtaaaagcccaccaaggcgacgatctgtagctggtctgagaggacgaccagccacactggaactgagacacggtccagactcctacgggaggcagcagtggggaattttggacaatgggcgcaagcctgatccagcaatgccgcgtgcaggatgaaggccttcgggttgtaaactgcttttgtacggaacgaaacggctccttctaatataaggggctaatgacggtaccgtaagaataagcaccggctaactacgtgccagcagccgcggtaatacgtagggtgcgagcgttaatcggaattactgggcgtaaagcgtgcgcaggcggttatataagacagatgtgaaatccccgggctcaacctgggacctgcatttgtgactgtatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatttgccagagatggcttagtgctcgaaagagagccgtaacacaggtgctgcatggctgtcgtcagctcgtgtcgtgagatgttgggttaagtcccgcaacgagcgcaacccttgtcattagttgctacatttagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccacaaagccagtcgtagtccggatcgtagtctgcaactcgactacgtgaagtcggaatcgctagtaatcgtggatcagaatgtcacggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctg

SEQ ID NO: 7783 - DNA, 1545 bp, Rhodoferax sp. OTU1
  ref <308>: DATABASE ACCESSION NUMBER: NCBI ACCESSION: NZ_QEII01000196.1
  ref <309>: DATABASE ENTRY DATE: 2019-04-01
  ref <313>: RELEVANT RESIDUES IN SEQ ID NO: (1)..(1545)
agatcgaactatagagtttgatcctggctcagattgaacgctggcggcatgccttacacatgcaagtcgaacggcagcacgggagcaatcctggtggcgagtggcgaacgggtgagtaatatatcggaacgtgcccagtcgtgggggataacgcagcgaaagctgtgctaataccgcatacgatctctggatgaaagcgggggactcgcaagagcctcgcgcgattggagcggccgatatcagattagctagttggtggggtaaaagcccaccaaggcgacgatctgtagctggtctgagaggacgaccagccacactggaactgagacacggtccagactcctacgggaggcagcagtggggaattttggacaatgggcgcaagcctgatccagcaatgccgcgtgcaggatgaaggccttcgggttgtaaactgcttttgtacggaacgaaacggtctgccttaatacggtgggctaatgacggtaccgtaagaataagcaccggctaactacgtgccagcagccgcggtaatacgtagggtgcgagcgttaatcggaattactgggcgtaaagcgtgcgcaggcggttatataagacagatgtgaaatccccgggctcaacctgggacctgcatttgtgactgtatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaactcgccagagatggcttggtgctcgaaagagagccgtaacacaggtgctgcatggctgtcgtcagctcgtgtcgtgagatgttgggttaagtcccgcaacgagcgcaacccttgtcattagttgctacattcagttgggcactctaatgagactgccggtgacaagccggaggaaggtggggatgacgtcaagtcctcatggcccttataggtggggctacacacgtcatacaatggctggtacaaagggttgccaacccgcgagggggagctaatcccacaaagccagtcgtagtccggatcgtagtctgcaactcgactacgtgaagtcggaatcgctagtaatcgtggatcagaatgtcacggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctg

SEQ ID NO: 7784 - DNA, 1540 bp, Rhodoferax sp. YR267
  ref <308>: DATABASE ACCESSION NUMBER: NCBI ACCESSION: NZ_QEOJ01000005.1
  ref <309>: DATABASE ENTRY DATE: 2019-04-01
  ref <313>: RELEVANT RESIDUES IN SEQ ID NO: (1)..(1540)
gaactatagagtttgatcctggctcagattgaacgctggcggcatgccttacacatgcaagtcgaacggcagcacgggagcaatcctggtggcgagtggcgaacgggtgagtaatatatcggaacgtgcccagtcgtgggggataacgcagcgaaagctgtgctaataccgcatacgatctctggatgaaagcgggggactcgcaagagcctcgcgcgattggagcggccgatatcagattagctagttggtggggtaaaagcccaccaaggcgacgatctgtagctggtctgagaggacgaccagccacactggaactgagacacggtccagactcctacgggaggcagcagtggggaattttggacaatgggcgcaagcctgatccagcaatgccgcgtgcaggatgaaggccttcgggttgtaaactgcttttgtacggaacgaaacggtctgccctaatacggtgggctaatgacggtaccgtaagaataagcaccggctaactacgtgccagcagccgcggtaatacgtagggtgcgagcgttaatcggaattactgggcgtaaagcgtgcgcaggcggttatgtaagacagatgtgaaatccccgggctcaacctgggacctgcatttgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaagtcgctagagatagcttcgtgctcgaaagagagccgtaacacaggtgctgcatggctgtcgtcagctcgtgtcgtgagatgttgggttaagtcccgcaacgagcgcaacccttgtcattagttgctacatttagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcctaaccgtaaggagggcgattaccacggcagggttcgtgactggggtgaagtcgtaacaaggtagccgtatcggaaggtgcggctggatcacctcctttctg

SEQ ID NO: 7785 - DNA, 1523 bp, Rhodohalobacter sp. SW132
  ref <308>: DATABASE ACCESSION NUMBER: NCBI ACCESSION: NZ_QUOK01000022.1
  ref <309>: DATABASE ENTRY DATE: 2019-04-01
  ref <313>: RELEVANT RESIDUES IN SEQ ID NO: (1)..(1523)
atggagagtttgatcctggctcaggacgaacgctggcggcgggcttaacacatgcaagtcgaaggagaaggaaagagcttgctctttctggagactggcgcacggatgagtaacgcgtaggcaatctgcccatagcagggagataaccactggaaacggtggctaatatcgcataatgcagcggggtcgcatgaccgcagttgttaaaggccttcgggtcggctatggatgagcctgcgtgccattagttagttggtagggtaacggcctaccaaggcaatgatggctagggggtctgagaggatgatcccccacactgggactgagacacggcccagactcctacgggaggcagcagtgaggaatcttgcgcaatggaggaaactctgacgcagccacgccgcgtgccggaagacggccctatgggttgtaaacggcttttgattgggaagaacaggtgggatttgtcctgctttgacggtaccatttgaataagcaccggctaactccgtgccagcagccgcggtaatacggagggtgcaagcgttgtccggaatcattgggtgtaaagggtgcgtaggctggcatctaagtctggggtgaaatcttgccgcttaacggtaaaattgccctggatactggatgtcttgaatctgacagaggtcggtggaattcgtggtgtagcggtgaaatgcatagatatcacgaagaacatcagtggcgaaggcggccggctgggtcagtattgacgctgaggcacgagagcgtggggagcgaacaggattagataccctggtagtccacgctgtaaacgatgtatgctagttgttgggccttcgggttcagtgacgcagttaacgcagtaagcataccacctggggagtacgttcgcaagaatgaaactcaaaggaattgacgggggcccgcacaagcggtggagcatgtggcttaattcgatgcaacgcgaagaaccttacccgggctaaatccacgatgaccgcccccgaaacggggcttcccttcggggcatcatggaaggtgctgcatggctgtcgtcagctcgtgccgtgaggtgttgccttaagtggcgcaacgagcgcaacccctgtggttagttaccagcacgtaatggtggggactctagccagactgcctacgcaagtagtgaggaaggtggggacgacgtcaagtcatcatggcccttatgtccggggctgcacacgtgctacaatggatggtacagagggaagctacccagcaatgggatgcagatctccaaagccattcccagttcggattggagtctgcaactcgactccatgaaggtggaatcgctagtaatcgcgtatcagcaatgacgcggtgaatacgttcccgggccttgtacacaccgcccgtcaagcgatggaagtcaggagtacctaaagttgccgttcaacgcggtacctagggtaagcctggtaactggcgctaagtcgtaacaaggtagccgtaccggaaggtgcggctggatcacctcctaa

SEQ ID NO: 7786 - DNA, 1488 bp, Rhodomicrobium sp. JA980
  ref <308>: DATABASE ACCESSION NUMBER: NCBI ACCESSION: NZ_RZNF01000012.1
  ref <309>: DATABASE ENTRY DATE: 2019-04-01
  ref <313>: RELEVANT RESIDUES IN SEQ ID NO: (1)..(1488)
tcaatctgagagtttgatcctggctcagaacgaacgctggcggcaggcttaacacatgcaagtcgaacgcaccgcaaggtgagtggcagacgggtgagtaacgcgtgggaaccttccctttggtacggaataacttcgggaaaccgaagctaataccgtatatctcctgcgggagaaagatttatcgccaaaggatgggcccgcgttggattagctagttggtgtggtaatggcgcaccaaggcgacgatccatagctggtctgagaggatgatcagccacactgggactgagacacggcccagactcctacgggaggcagcagtggggaatattggacaatgggggcaaccctgatccagccatgccgcgtgagtgaagaaggccttagggttgtaaagctcttttggcggggacgataatgacggtacccgcagaataagccccggctaacttcgtgccagcagccgcggtaatacgaagggggctagcgttgttcggaatcactgggcgtaaagcgtacgcaggcggattgataagtcaggggtgaaatcccggggctcaacctcggaattgcctttgatactgtctgtcttcgagttcgggagaggttggcggaattcctagtgtagaggtgaaattcgtagatattaggaagaacaccagtggcgaaggcggccaactggcccgatactgacgctcatgtacgaaagcgtggggagcaaacaggattagataccctggtagtccacgctgtaaactatggatgctagccgttggggagcttgctcttcagtggcgcagctaacgtcttaagcatcccgcctggggagtacggtcgcaagattaaaactcaaaggaattgacgggggcccgcacaagcggtggagcatgtggtttaattcgaggcaacgcgaagaaccttaccagctcttgacatgtcgtgctacgtggagagattcacggttcccttcggggacgcgaacacaggtgctgcatggctgtcgtcagctcgtgtcgtgagatgttgggttaagtcccgcaacgagcgcaaccctcgcccttagttgctaccattaagttgagcactctaaggggaccgccggtgataagccggaggaaggtggggatgacgtcaagtcatcatggcccttacgggctgggctacacacgtgctacaatggcggtgacagtgggcagcgacacagcgatgtgatgctaatcccaaaaagccgtctcagttcagattgcactctgcaactcgagtgcatgaagtcggaatcgctagtaatcgcggatcagcatgccgcggtgaatacgttcccgggccttgtacacaccgcccgtcacaccatgggagttggttttacccgaaggcgttacgctaaccgcaaggaggcagacgaccacggtaaggtcagcgactggggtgaagtcgtaacaaggtagccgtaggggaacctgcggctggatcacctcctttctaagg

SEQ ID NO: 7787 - DNA, 1480 bp, Rhodomicrobium sp. R RK 3
  ref <308>: DATABASE ACCESSION NUMBER: NCBI ACCESSION: NZ_MWLK01000016.1
  ref <309>: DATABASE ENTRY DATE: 2019-04-01
  ref <313>: RELEVANT RESIDUES IN SEQ ID NO: (1)..(1480)
tgagagtttgatcctggctcagaacgaacgctggcggcaggcctaatacatgcaagtcgaacgcaccttcgggtgagtggcagacgggtgagtaacgcgtgggaaccttccttgtagtacggaataactccgggaaaccggtgctaataccgtatacgccctccgggggaaagatttatcgctacaagatgggcccgcgtcggattagctagttggtgaggtaatggctcaccaaggcgacgatccgtagctggtctgagaggatgatcagccacactgggactgagacacggcccagactcctacgggaggcagcagtagggaatcttggacaatgggcgaaagcctgatccagccatgccgcgtgagtgaagaaggccttagggttgtaaagctcttttggcggggacgataatgacggtacccgcagaataagccccggctaacttcgtgccagcagccgcggtaatacgaagggggctagcgttgttcggaattactgggcgtaaagcgcacgcaggcggattgataagtcgggggtgaaatcccggggctcaacctcggaattgccttcgatactgtcagtcttgagtccgggagaggtgagtggaattcctagtgtagaggtgaaattcgtagatattaggaagaacaccagtggcgaaggcggctcactggcccggtactgacgctcatgtgcgaaagcgtggggagcaaacaggattagataccctggtagtccacgccgtaaacgatggatgctagccgttggggagcttgctcttcggtggcgcagctaacgtattaagcatcccgcctggggagtacggtcgcaagattaaaactcaaaggaattgacgggggcccgcacaagcggtggagcatgtggtttaattcgaggcaacgcgaagaaccttaccagctcttgacatcccgagaaccctagcagagatgcatgggggtgccgcaaggaactcggtgacaggtgctgcatggctgtcgtcagctcgtgtcgtgagatgttgggttaagtcccgcaacgagcgcaaccctcgcccttagttgccagcattcagttgggcactctagggggactgccggtgataagccggaggaaggtggggatgacgtcaagtcatcatggcccttacgggctgggctacacacgtgctacaatggcggtgacagtgggcagctactgcgcgagcagatgctaatcccaaaaagccgcctcagttcagattgcactctgcaactcgagtgcatgaagtcggaatcgctagtaatcgcggatcagcatgccgcggtgaatacgttcccgggccttgtacacaccgcccgtcacaccatgggagttggttttacccgaaggcgtttcgctaaccgcaaggaggcaaacgaccacggtagggtcagcgactggggtgaagtcgtaacaaggtagccgtaggggaacctgcggctggatcacctcctttct

SEQ ID NO: 7788 - DNA, 1489 bp, Rhodomicrobium udaipurense
  ref <308>: DATABASE ACCESSION NUMBER: NCBI ACCESSION: NZ_JFZJ01000165.1
  ref <309>: DATABASE ENTRY DATE: 2019-04-01
  ref <313>: RELEVANT RESIDUES IN SEQ ID NO: (1)..(1489)
aatctgagagtttgatcctggctcagaacgaacgctggcggcaggcttaacacatgcaagtcgaacgcaccgcaaggtgagtggcagacgggtgagtaacgcgtgggaaccttccctttggtacggaataacttcgggaaaccgaagctaataccgtatatctcctccgggagaaagatttatcgccaaaggatgggcccgcgttggattagctagttggtgtggtaaaggcgcaccaaggcgacgatccatagctggtctgagaggatgatcagccacactgggactgagacacggcccagactcctacgggaggcagcagtggggaatcttggacaatgggggcaaccctgatccagccatgccgcgtgagtgaagaaggccttagggttgtaaagctcttttggcggggacgataatgacggtacccgcagaataagccccggctaacttcgtgccagcagccgcggtaatacgaagggggctagcgttgttcggaatcactgggcgtaaagcgtacgcaggcggatagataagtcaggggtgaaatcccggggctcaacctcggaattgcctttgatactgtctatcttcgagttcgggagaggttggcggaattcctagtgtagaggtgaaattcgtagatattaggaagaacaccagtggcgaaggcggccaactggcccgatactgacgctcatgtacgaaagcgtggggagcaaacaggattagataccctggtagtccacgctgtaaactatggatgctagccgttggggagcttgctcttcagtggcgcagctaacgtcttaagcatcccgcctggggagtacggtcgcaagattaaaactcaaaggaattgacgggggcccgcacaagcggtggagcatgtggtttaattcgaggcaacgcgaagaaccttaccagctcttgacatgtcgtgctacgtggagagattcacggttcccttcggggacgcgaacacaggtgctgcatggctgtcgtcagctcgtgtcgtgagatgttgggttaagtcccgcaacgagcgcaaccctcgcccttagttgctaccatttagttgagcactctaaggggaccgccggtgataagccggaggaaggtggggatgacgtcaagtcatcatggcccttacgggctgggctacacacgtgctacaatggcggtgacagtgggcagcgacacagcgatgtgatgctaatcccaaaaagccgtctcagttcagattgcactctgcaactcgagtgcatgaagtcggaatcgctagtaatcgcggatcagcatgccgcggtgaatacgttcccgggccttgtacacaccgcccgtcacaccatgggagttggttttacccgaaggcgttacgctaaccgcaaggaggcagacgaccacggtaaggtcagcgactggggtgaagtcgtaacaaggtagccgtaggggaacctgcggctggatcacctcctttctaaggaag

SEQ ID NO: 7789 - DNA, 1528 bp, Rhodonellum psychrophilum
  ref <308>: DATABASE ACCESSION NUMBER: NCBI ACCESSION: NZ_AWXR01000164.1
  ref <309>: DATABASE ENTRY DATE: 2019-04-01
  ref <313>: RELEVANT RESIDUES IN SEQ ID NO: (1)..(1528)
tacaatggagagtttgatcctggctcaggatgaacgctagcggcaggcctaatacatgcaagtcgaacgggatccagaagcttgcttttggtgagagtggcgcacgggtgcgtaacgcgtatgcaacctaccttatacagggggatagcccggggaaacccggattaataccccgtagtatttatttcctgcatgggagattgattaaagccttcgggcggtataagacgggcatgcgtaggattagctagttggtaaggtaacggcttaccaaggcgacgatccttaggggttctgagaggaaggtcccccacactggcactgagatacgggccagactcctacgggaggcagcagtagggaatattgggcaatggtcgcaagactgacccagccatgccgcgtgcaggaagacggcgttatgcgttgtaaactgcttttatacgggaagaaaatgccactgcggtggaacttgccggtaccgtatgaataagcaccggctaactccgtgccagcagccgcggtaatacggagggtgcaagcgttgtccggatttattgggtttaaagggtgcgtaggcggccgtttaagtcagtggtgaaagtacagggctcaaccctgtaactgccattgatactggacggcttgagtgttgatggggtacatggaatttatggtgtagcggtgaaatgcatagataccataaggaacaccgatagcgaaggcattgtacttatcaacaactgacgctgaggcacgaaagcgtgggtagcgaacaggattagataccctggtagtccacgccgtaaacgatgatcactcgctgttatctccttcgcggggtagtggcttagggaaaccgttaagtgatccacctggggagtacgcccgcaagggtgaaactcaaaggaattgacgggggtccgcacaagcggtggagcatgtggtttaattcgatgatacgcgaggaaccttacctgggctagaatgtgaaggaatggtttagagatagatcagtcagcaatgacctgaaacaaggtgctgcatggctgtcgtcagctcgtgccgtgaggtgttgggttaagtcccgcaacgagcgcaacccctatgtttagttgccagcacgtcaaggtggggactctagacagactgcctgcgcaagcagagaggaaggaggggacgacgtcaagtcatcatggcccttacgcccagggcgacacacgtgctacaatggcgcatacagcgggtagctacctggcaacaggatgccaacctctaaaagtgcgtctcagttcggatcggggtctgcaactcgaccccgtgaagctggaatcgctagtaatcgcgcatcagccatggcgcggtgaatacgttcccggaccttgtacacaccgcccgtcaagccatggaagtcgggtagacctaaagccggtaaccgcaaggagccgtttagggtagaaccggtaactggggctaagtcgtaacaaggtagccgtaccggaaggtgcggctggaacacctcctttct

SEQ ID NO: 7790 - DNA, 1511 bp, Rhodopila globiformis
  ref <308>: DATABASE ACCESSION NUMBER: NCBI ACCESSION: NZ_NHRY01000182.1
  ref <309>: DATABASE ENTRY DATE: 2019-04-01
  ref <313>: RELEVANT RESIDUES IN SEQ ID NO: (1)..(1511)
atgaacctgagagtttgatcctggctcagagcgaacgctggcggcatgcttaacacatgcaagtcgcacgggcagcttcggctgtcagtggcggacgggtgagtaacgcgtaggcatctatccctgggtgggggacaaccgtgggaaactacggctaataccgcatgacacctgcgggtcaaaggcgccggggcaacctggcatcgcctggggcggagcctgcgtacgattagctggttggtggggtaaaggcctaccaaggcgacgatcgttagctggtctgagaggatgatcagccacactgggactgagacacggcccagactcctacgggaggcagcagtggggaatattggacaatgggcgcaagcctgatccagcaatgccgcgtgtgtgaagaaggtcttcggattgtaaagcactttcggcggggacgatgatgacggtacccgcagaagaagccccggctaacttcgtgccagcagccgcggtaatacgaagggggctagcgttgctcggaatgactgggcgtaaagggcgcgtaggcggtttgtacagtcaggtgtgaaattcccgggctcaacctgggggctgcacttgatacgtatggacttgagtggggaagagggtcgtggaattcccagtgtagaggtgaaattcgtagatattgggaagaacaccggtggcgaaggcggcgacctggtccttgactgacgctgaggcgcgaaagcgtggggagcaaacaggattagataccctggtagtccacgccgtaaacgatgtgcgctggatgttgggcggcttagccgctcagtgtcgcagctaacgcgctaagcgcaccgcctggggagtacggccgcaaggttgaaactcaaaggaattgacgggggcccgcacaagcggtggagcatgtggtttaattcgaagcaacgcgcagaaccttaccagggcttgacatgggcaagtcgcgtccggagacgggcgttcccgcaagggcttgccgcacaggtgctgcatggctgtcgtcagctcgtgtcgtgagatgttgggttaagtcccgcaacgagcgcaaccctcgcctttagttgccagcacgtttgggtgggcactctaaaggaactgccggtgacaagccggaggaaggtggggatgacgtcaagtcctcatggcccttatgtcctgggctacacacgtgctacaatggcggtgacagtgggacgccaggccgcgaggccgtgctgatcccgaaaagccgtctcagttcggattgcactctgcaactcgggtgcatgaaggtggaatcgctagtaatcgcggatcagcacgccgcggtgaatacgttcccgggccttgtacacaccgcccgtcacaccatgggagttggttcgaccttaagccggtgcgccaacccagcaatggggggcagccgaccacggtcgggttagcgactggggtgaagtcgtaacaaggtagccgtaggggaacctgcggctggatcacctcctttcaag

SEQ ID NO: 7791 - DNA, 1489 bp, Rhodoplanes elegans
  ref <308>: DATABASE ACCESSION NUMBER: NCBI ACCESSION: NZ_NPEU01000356.1
  ref <309>: DATABASE ENTRY DATE: 2019-04-01
  ref <313>: RELEVANT RESIDUES IN SEQ ID NO: (1)..(1489)
tccaacctgagagtttgatcctggctcagagcgaacgctggcggcaggcttaacacatgcaagtcgagcgccccgcaaggggagcggcagacgggtgagtaacacgtgggaacgtaccctttggttcggaacaacccagggaaacttgggctaataccggataagtccgcgaggagaaagatttatcgccgaaggatcggcccgcgtctgattagctagttggtgtggtaacggcgcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcggtggggaagataatgacggtacccacagaagaagccccggctaacttcgtgccagcagccgcggtaatacgaagggggctagcgttgctcggaatcactgggcgtaaagcgcacgtaggcggctttctaagtcaggggtgaaatcccggagctcaactccggaactgcctttgatactgggaggctcgagtccgggagaggtgagtggaactgcgagtgtagaggtgaaattcgtagatattcgcaagaacaccagtggcgaaggcggctcactggcccggtactgacgctgaggtgcgaaagcgtggggagcaaacaggattagataccctggtagtccacgccgtaaacgatggatgctagccgttggcgagcttgctcgtcagtggcgcagctaacgccttaagcatcccgcctggggagtacggtcgcaagattaaaactcaaaggaattgacgggggcccgcacaagcggtggagcatgtggtttaattcgaagcaacgcgcagaaccttaccagctcttgacatgccacgacggtttccggagacggactcctccccgcaaggggcgtggacacaggtgctgcatggctgtcgtcagctcgtgtcgtgagatgttgggttaagtcccgcaacgagcgcaaccctcgcccttagttgccaccattcagttgggcactctaaggggactgccggtgataagccgcgaggaaggtggggatgacgtcaagtcctcatggcccttacgggctgggctacacacgtgctacaatggcggtgacagtgggacgcgaaggggtgacccttagcaaatctcaaaaagccgtctcagttcggattgggctctgcaactcgagcccatgaagttggaatcgctagtaatcgcagatcagcacgctgcggtgaatacgttcccgggccttgtacacaccgcccgtcacaccatgggagttggctttacctgaaggcgttgcgctaacccgcaagggaggcaggcgaccacggtagggtcagcgactggggtgaagtcgtaacaaggtagccgtaggggaacctgcggctggatcacctcctttct

SEQ ID NO: 7792 - DNA, 1493 bp, Rhodoplanes piscinae
  ref <308>: DATABASE ACCESSION NUMBER: NCBI ACCESSION: NZ_UWOC01000133.1
  ref <309>: DATABASE ENTRY DATE: 2019-04-01
  ref <313>: RELEVANT RESIDUES IN SEQ ID NO: (1)..(1493)
tccaacctgagagtttgatcctggctcagagcgaacgctggcggcaggcttaacacatgcaagtcgaacgggcgcagcaatgcgtcagtggcagacgggtgagtaacacgtgggaacgtgcctttcggttcggaacaactgagggaaacttcagctaataccggatacgcccgcaaggggaaagatttatcgccgaaagatcggcccgcgtctgattagctagttggtggggtaatggcccaccaaggcgacgatcagtagctggtctgagaggatgatcagccacactgggactgagacacggcccagactcctacgggaggcagcagtggggaatattggacaatgggggaaaccctgatccagccatgccgcgtgagtgatgaaggccctagggttgtaaagctctttcggtggggaagataatgacggtacccacagaagaagccccggctaacttcgtgccagcagccgcggtaatacgaagggggctagcgttgctcggaatcactgggcgtaaagcgcacgtaggcggctttctaagtcaggggtgaaatcccggagctcaactccggaactgcctttgatactggaaagctcgagtccgggagaggtgagtggaactgcgagtgtagaggtgaaattcgtagatattcgcaagaacaccagtggcgaaggcggctcactggcccggtactgacgctgaggtgcgaaagcgtggggagcaaacaggattagataccctggtagtccacgccgtaaacgatggatgctagccgttggcgagcttgctcgtcagtggcgcagctaacgccttaagcatcccgcctggggagtacggtcgcaagattaaaactcaaaggaattgacgggggcccgcacaagcggtggagcatgtggtttaattcgaagcaacgcgcagaaccttaccagcccttgacatgccacgacggtttccagagatggactcctccccgcaaggggcgtggacacaggtgctgcatggctgtcgtcagctcgtgtcgtgagatgttgggttaagtcccgcaacgagcgcaaccctcgcccttagttgccaccattcagttgggcactctaaggggactgccggtgataagccgcgaggaaggtggggatgacgtcaagtcctcatggcccttacgggctgggctacacacgtgctacaatggcggtgacagtgggacgcgaaggggtgacccttagcaaatctcaaaaagccgtctcagttcggattgggctctgcaactcgagcccatgaagtcggaatcgctagtaatcgcagatcagcacgctgcggtgaatacgttcccgggccttgtacacaccgcccgtcacaccatgggagttggctttacctgaagacggtgcgctaaccgaaagggggcagccggccacggtagggtcagcgactggggtgaagtcgtaacaaggtagccgtaggggaacctgcggctggatcacctcctttctaa

SEQ ID NO: 7793 - DNA, 1495 bp, Rhodoplanes roseus
  ref <308>: DATABASE ACCESSION NUMBER: NCBI ACCESSION: NZ_NPEX01000003.1
  ref <309>: DATABASE ENTRY DATE: 2019-04-01
  ref <313>: RELEVANT RESIDUES IN SEQ ID NO: (1)..(1495)
tccaacctgagagtttgatcctggctcagagcgaacgctggcggcaggcttaacacatgcaagtcgagcgcccgtagcaatacgggagcggcagacgggtgagtaacacgtgggaacgtaccctttggttcggaacaacccagggaaacttgggctaataccggataagtccgcgaggagaaagatttatcgccgaaggatcggcccgcgtctgattagctagttggtgtggtaacggcgcaccaaggcgacgatcagtagctggtctgagaggatgatcagccacactgggactgagacacggcccagactcctacgggaggcagcagtggggaatattggacaatgggggaaaccctgatccagccatgccgcgtgagtgatgaaggccttagggttgtaaagctctttcagtggggaagataatgacggtacccacagaagaagccccggctaacttcgtgccagcagccgcggtaatacgaagggggctagcgttgctcggaatcactgggcgtaaagcgcacgtaggcggctttctaagtcaggggtgaaatcccggagctcaactccggaactgcccttgatactggagagctcgagtccgggagaggtgagtggaactgcgagtgtagaggtgaaattcgtagatattcgcaagaacaccagtggcgaaggcggctcactggcccggtactgacgctgaggtgcgaaagcgtggggagcaaacaggattagataccctggtagtccacgccgtaaacgatggatgctagccgttgggcagcttgctgctcagtggcgcagctaacgctttaagcatcccgcctggggagtacggtcgcaagattaaaactcaaaggaattgacgggggcccgcacaagcggtggagcatgtggttcaattcgaagcaacgcgcagaaccttaccagctcttgacatgccacgacggtttccggagacggactcctccccgcaaggggcgtggacacaggtgctgcatggctgtcgtcagctcgtgtcgtgagatgttgggttaagtcccgcaacgagcgcaaccctcgcccttagttgccatcattcagttgggcactctaaggggactgccggtgataagccgcgaggaaggtggggatgacgtcaagtcctcatggcccttacgggctgggctacacacgtgctacaatggcggtgacagtgggacgcgaaggggcaacccttagcaaatctcaaaaagccgtctcagttcggattggggtctgcaactcgaccccatgaagtcggaatcgctagtaatcgcagatcagcacgctgcggtgaatacgttcccgggccttgtacacaccgcccgtcacaccatgggagttggttttacctgaaggcgctgcgctaactcagcaatgagaggcaggcgaccacggtagggtcagcgactggggtgaagtcgtaacaaggtagccgtaggggaacctgcggctggatcacctcctttct

SEQ ID NO: 7794 - DNA, 1493 bp, Rhodoplanes sp. Z2-YC6860
  ref <308>: DATABASE ACCESSION NUMBER: NCBI ACCESSION: NZ_CP007440.1
  ref <309>: DATABASE ENTRY DATE: 2019-04-01
  ref <313>: RELEVANT RESIDUES IN SEQ ID NO: (1)..(1493)
tccaacttgagagtttgatcctggctcagagcgaacgctggcggcaggcctaacacatgcaagtcgagcgccccgcaaggggagcggcagacgggagagtaacacgtgggaacatgcccttcagtacggaacaaccaagggaaactttggctaataccgtatacgtccgtaaggagaaagatttatcgctgaaggattggcccgcgtctgattagctagttggtgaggtaatggctcaccaaggcgacgatcagtagctggtctgagaggatgatcagcctcactgggactgagacacggcccagactcctacgggaggcagcagtggggaatattggacaatgggcgcaagcctgatccagccatgccgcgtggatgatgaaggccctagggttgtaaagtcctttcggcggggaagataatgacggtacccgcagaagaagccccggctaacttcgtgccagcagccgcggtaatacgaagggggctagcgttgctcggaatcactgggcgtaaagcgcacgtaggcggactcttaagtcggtggtgaaatcctggagctcaactccagaactgccttcgatactgagagtctcgagtccgggagaggtgagtggaactgcgagtgtagaggtgaaattcgtagatattcgcaagaacaccagtggcgaaggcggctcactggcccggtactgacgctgaggtgcgaaagcgtggggagcaaacaggattagataccctggtagtccacgccgtaaacgatggatgctagccgttggcaggcttgcctgtcagtggcgcagctaacgcattaagcatcccgcctggggagtacggtcgcaagattaaaactcaaaggaattgacgggggcccgcacaagcggtggagcatgtggttcaattcgaagcaacgcgcagaaccttaccaacctttgacatgtcccgtatgggtaccagagatggaacccttcagttcggctggcgggaacacaggtgctgcatggctgtcgtcagctcgtgtcgtgagatgttgggttaagtcccgcaacgagcgcaaccctcgcccttagttgccatcattcagttgggcactctaaggggactgccggtgataagccgcgaggaaggtggggatgacgtcaagtcctcatggcccttacaggttgggctacacacgtgctacaatggcggtgacaatgggatgcaatggagcgatccttcgcaaatctcaaaaaaccgtctcagttcggattgcactctgcaactcgagtgcatgaagttggaatcgctagtaatcgcagatcagcacgctgcggtgaatacgttcccgggccttgtacacaccgcccgtcacaccatgggagttggttttacctgaagacggtgcgctaaccgcaaggaggcagccggccacggtaggatcagcgactggggtgaagtcgtaacaaggtagccgtaggggaacctgcggctggatcacctcctttctaagg

SEQ ID NO: 7795 - DNA, 1493 bp, Rhodopseudomonas faecalis
  ref <308>: DATABASE ACCESSION NUMBER: NCBI ACCESSION: NZ_QJTI01000047.1
  ref <309>: DATABASE ENTRY DATE: 2019-04-01
  ref <313>: RELEVANT RESIDUES IN SEQ ID NO: (1)..(1493)
tccaacttgagagtttgatcctggctcagagcgaacgctggcggcaggcttaacacatgcaagtcgaacgggcgtagcaatacgtcagtggcagacgggtgagtaacgcgtgggaacgtaccttttggttcggaacaactgagggaaacttcagctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtttctaagtcagaggtgaaagcctggagctcaactccagaactgcctttgatactggaagtcttgagtatggcagaggtgagtggaactgcgagtgtagaggtgaaattcgtagatattcgcaagaacaccagtggcgaaggcggctcactgggccattactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccctcgcaaatctcaaaaagccgtctcagttcggattgggctctgcaactcgagcccatgaagttggaatcgctagtaatcgtggatcagcatgccacggtgaatacgttcccgggccttgtacacaccgcccgtcacaccatgggagttggttttacctgaaggtagtgcgctaacccgcaagggaggcagctaaccacggtagggtcagcgactggggtgaagtcgtaacaaggtagccgtaggggaacctgcggctggatcacctcctttct

SEQ ID NO: 7796 - DNA, 1495 bp, Rhodopseudomonas palustris
  ref <308>: DATABASE ACCESSION NUMBER: NCBI ACCESSION: NZ_QYYC01000015.1
  ref <309>: DATABASE ENTRY DATE: 2019-04-01
  ref <313>: RELEVANT RESIDUES IN SEQ ID NO: (1)..(1495)
tccaacttgagagtttgatcctggctcagagcgaacgctggcggcaggcttaacacatgcaagtcgaacgggcgtagcaatacgtcagtggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggaaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtttctaagtcagaggtgaaagcctggagctcaactccagaactgcctttgatactggaagtcttgagtatggcagaggtgagtggaactgcgagtgtagaggtgaaattcgtagatattcgcaagaacaccagtggcgaaggcggctcactgggccattactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagacgcgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggaagctaaggggcgacccttcgcaaatctcaaaaagccgtctcagttcggattgggctctgcaactcgagcccatgaagttggaatcgctagtaatcgtggatcagcatgccacggtgaatacgttcccgggccttgtacacaccgcccgtcacaccatgggagttggctttacctgaagacggtgcgctaaccagcaatgggggcagccggccacggtagggtcagcgactggggtgaagtcgtaacaaggtagccgtaggggaacctgcggctggatcacctcctttctaa

SEQ ID NO: 7797 - DNA, 1493 bp, Rhodopseudomonas pentothenatexigens
  ref <308>: DATABASE ACCESSION NUMBER: NCBI ACCESSION: NZ_UFQQ01000055.1
  ref <309>: DATABASE ENTRY DATE: 2019-04-01
  ref <313>: RELEVANT RESIDUES IN SEQ ID NO: (1)..(1493)
tccaacttgagagtttgatcctggctcagagcgaacgctggcggcaggcttaacacatgcaagtcgaacgggcgtagcaatacgtcagtggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtttctaagtcagaggtgaaagcctggagctcaactccagaactgcctttgatactggaagtcttgagtatggcagaggtgagtggaactgcgagtgtagaggtgaaattcgtagatattcgcaagaacaccagtggcgaaggcggctcactgggccattactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagacgtgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggaagctaaggggcgacccttcgcaaatctcaaaaagccgtctcagttcggattgggctctgcaactcgagcccatgaagttggaatcgctagtaatcgtggatcagcatgccacggtgaatacgttcccgggccttgtacacaccgcccgtcacaccatgggagttggctttacctgaagacggtgcgctaacccgcaaggggggcagccggccacggtagggtcagcgactggggtgaagtcgtaacaaggtagccgtaggggaacctgcggctggatcacctcctttct

SEQ ID NO: 7798 - DNA, 1497 bp, Rhodopseudomonas pseudopalustris
  ref <308>: DATABASE ACCESSION NUMBER: NCBI ACCESSION: NZ_FODT01000025.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgaacgggcatagcaatatgtcagtggcagacgggtgagtaacgcgtgggaacgtaccttttggttcggaacaactgagggaaacttcagctaataccggataagcccttacggggaaagatttatcgccgaaagatcggcccgcgtctgattagctagttggtgtggtaaaggcgcaccaaggcgacgatcagtagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcagaggtgaaagcctggagctcaactccagaactgcctttgatactgaggatcttgagtatgggagaggtgagtggaactgcgagtgtagaggtgaaattcgtagatattcgcaagaacaccagtggcgaaggcggctcactggcccataactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggacgctaaggggcaacccttcgcaaatctcaaaaaaccgtctcagttcggattggagtctgcaactcgactccatgaagttggaatcgctagtaatcgtggatcagcatgccacggtgaatacgttcccgggccttgtacacaccgcccgtcacaccatgggagttggttctacctgaaggcagtgcgctaacccgcaagggaggcagctgaccacggtagggtcagcgactggggtgaagtcgtaacaaggtagccgtaggggaacctgcggctggatcacctcctttctaagg

SEQ ID NO: 7799 - DNA, 1495 bp, Rhodopseudomonas sp. AAP120
  ref <308>: DATABASE ACCESSION NUMBER: NCBI ACCESSION: NZ_LJIC01000108.1
  ref <309>: DATABASE ENTRY DATE: 2019-04-01
  ref <313>: RELEVANT RESIDUES IN SEQ ID NO: (1)..(1495)
tccaacttgagagtttgatcctggctcagagcgaacgctggcggcaggcttaacacatgcaagtcgaacgggcgtagcaatacgtcagtggcagacgggtgagtaacacgtgggaacgtaccttttggttcggaacaactgagggaaacttcagctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgaaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcagaggtgaaagcctggagctcaactccagaactgcctttgatactgaggatcttgagtatgggagaggtgagtggaactgcgagtgtagaggtgaaattcgtagatattcgcaagaacaccagtggcgaaggcggctcactggcccataactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccctcgcaaatctcaaaaagccgtctcagttcggattgggctctgcaactcgagcccatgaagttggaatcgctagtaatcgtggatcagcatgccacggtgaatacgttcccgggccttgtacacaccgcccgtcacaccatgggagttggttttacctgaagacggtgcgctaaccgcaaggaggcagccggccacggtagggtcagcgactggggtgaagtcgtaacaaggtagccgtaggggaacctgcggctggatcacctcctttctaagg

SEQ ID NO: 7800 - DNA, 1497 bp, Rhodopseudomonas sp. B29
  ref <308>: DATABASE ACCESSION NUMBER: NCBI ACCESSION: NZ_BADD01000237.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgaacgggcgtagcaatacgtcagtggcagacgggtgagtaacacgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtttctaagtcagaggtgaaagcctggagctcaactccagaactgcctttgatactggaagtcttgagtatggcagaggtgagtggaactgcgagtgtagaggtgaaattcgtagatattcgcaagaacaccagtggcgaaggcggctcactgggccattactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggacgctaaggggtgacccttcgcaaatctcaaaaagccgtctcagttcggattgggctctgcaactcgagcccatgaagttggaatcgctagtaatcgtggatcagcatgccacggtgaatacgttcccgggccttgtacacaccgcccgtcacaccatgggagttggctttacctgaagacggtgcgctaaccagcaatggaggcagccggccacggtagggtcagcgactggggtgaagtcgtaacaaggtagccgtaggggaacctgcggctggatcacctcctttctaagg

SEQ ID NO: 7801 - DNA, 1493 bp, Rhodopseudomonas thermotolerans; identical to SEQ ID NO: 7797
  ref <308>: DATABASE ACCESSION NUMBER: NCBI ACCESSION: NZ_QUMP01000055.1
  ref <309>: DATABASE ENTRY DATE: 2019-04-01
  ref <313>: RELEVANT RESIDUES IN SEQ ID NO: (1)..(1493)

SEQ ID NO: 7802 - DNA, 711 bp, Rhodosalinus sediminis
  ref <308>: DATABASE ACCESSION NUMBER: NCBI ACCESSION: NZ_QOHR01000084.1
  ref <309>: DATABASE ENTRY DATE: 2019-04-01
  ref <313>: RELEVANT RESIDUES IN SEQ ID NO: (1)..(711)
gggaacgtgcctctctctacggaatagccccgggaaactgggattaatgccgtatacgcccttcgggggaaagatttttcggagagggatcggcccgcgtctgattaggtagttggtggggtaacggcctaccaagccgacgatcagtagctggtttgagaggatgatcagccacactgggactgagacacggcccagactcctacgggaggcagcagtggggaatcttagacaatgggggcaaccctgatctagccatgccgcgtgagtgaagaaggccctagggtcgtaaagctctttcaccggggaagataatgacggtacccggagaagaaaccccggctaactccgtgccagcagccgcggtaatacggagggggttagcgttgttcggaattactgggcgtaaagcgcgcgtaggcggatcggaaagttgggggtgaaatcccggggctcaaccccggaactgccctcaaaactgtcggtctagagtccgggagaggtgagtggaactccgagtgtagaggtgaaattcgtagatattcggaagaacaccagtggcgaaggcggctcactggcccggtactgacgctgaggtgcgaaagcgtggggagcaaacaggattagataccctggtagtccacgccgtaaacgatgaatgccagacgtcgggcagcttgctgttcggtgtcgcacctaacggagtaagca

SEQ ID NO: 7803 - DNA, 1498 bp, Rhodospira trueperi
  ref <308>: DATABASE ACCESSION NUMBER: NCBI ACCESSION: NZ_FNAP01000038.1
  ref <309>: DATABASE ENTRY DATE: 2019-04-01
  ref <313>: RELEVANT RESIDUES IN SEQ ID NO: (1)..(1498)
tcattcaacgtgagagtttgatcctggctcaggacgaacgctggcggcaggcttaacacatgcaagtcgaacgctctcttcggagggagtggcgcacgggtgagtaacacgtgggaacctaccctgaggttcggaataaccgttggaaacgacggctaataccgaatgtcccttacgggggaaagatttatcgccttgggatgggcccgcggtcgattagctagttggtgaggtaaaggctcaccaaggcgacgatcgatagctggtctgagaggatgatcagccacactgggactgagacacggcccagactcctacgggaggcagcagtggggaatattggacaatgggggcaaccctgatccagccatgccgcgtgagtgatgaaggccttcgggttgtaaagctctttcaggtgggacgatgatgacggtaccaccagaagaagccccggctaacttcgtgccagcagccgcggtaatacgaagggggctagcgttgttcggatttactgggcgtaaagcgcgcgtaggcggtcatgccagtcagaggtgaaagcccagggctcaaccctggaacggcctttgatactgcatgacttgagttcgggagaggggcatggaattcccagtgtagaggtgaaattcgtagatattgggaagaacaccagtggcgaaggcggtgccctggcccgagactgacgctgaggtgcgaaagcgtggggagcaaacaggattagataccctggtagtccacgccgtaaacgatgagtgctagatgtcggggcgcatgcgtctcggtgtcgcagctaacgcattaagcactccgcctggggagtacggccgcaaggttaaaactcaaaggaattgacgggggcccgcacaagcggtggagcatgtggtttaattcgaagcaacgcgcagaaccttaccagcccttgacatcccgtgaccgccctagagatggggttttcccttcggggacacggagacaggtgctgcatggctgtcgtcagctcgtgtcgtgagatgttgggttaagtcccgcaacgagcgcaaccctcgccttcagttgccatcagttcggctgggcactctgaaggaactgccggtgacaagccggaggaaggtggggatgacgtcaagtcctcatggcccttacgggctgggctacacacgtgctacaatggcgactacagtgggcagcgacacagcgatgtgaagctaatctccaaaagtcgtctcagttcggattgcactctgcaactcgggtgcatgaagtcggaatcgctagtaatcgtggatcagcatgccacggtgaatacgttcccgggccttgtacacaccgcccgtcacaccatgggagttggctctacccgaagacggtgcgctaaccgtaagggggcagccggccacggtagggtcagcgactggggtgaagtcgtaacaaggtagccgtaggggaacctgcggctggatcacctcctttcaaggacgcg

SEQ ID NO: 7804 - DNA, 1500 bp, Rhodospirillaceae bacterium CCH5-H10
  ref <308>: DATABASE ACCESSION NUMBER: NCBI ACCESSION: NZ_LSKJ01000147.1
  ref <309>: DATABASE ENTRY DATE: 2019-04-01
  ref <313>: RELEVANT RESIDUES IN SEQ ID NO: (1)..(1500)
ttaaacttgagagtttgatcctggctcagaacgaacgctggcggcaggcttaacacatgcaagtcgaacgcgtgtagcaatacacgagtggcgcacgggtgagtaacgcgtggatatctgccttttggttcggaataactccgggaaactggagctaataccggatggttccttcgggataaagatttatcgccaaaagatgagtccgcgtacgattagctagttggtgaggtaatggctcaccaaggcgacgatcgttagctggtctgagaggacgatcagccacactgggactgagacacggcccagactcctacgggaggcagcagtggggaatattggacaatgggggcaaccctgatccagccatgccgcgtgagtgatgaaggccttcgggttgtaaagctcttttggcggggacgatgatgacggtacccgcagaataagccccggctaacttcgtgccagcagccgcggtaagacgaagggggctagcgttgttcggaattactgggcgtaaagcgagtgtaggtggttgttcaagttggatgtgaaagccttgagctcaactcaagaaatgcattcaggactgagcgactagaggaccggagaggatagtggaattcccagtgtagtggtgaaatacgtagagattgggaagaacaccagtggcgaaggcggctatctggacggtttctgacactaagactcgaaagcgtggggagcaaacaggattagataccctggtagtccacgccgtaaacgatgggtgctagacgttggcgagcttgctcgtcagtgtcgcagctaacgcgttaagcaccccgcctggggagtacggccgcaaggttgaaactcaaaggaattgacgggggcccgcacaagcggtggagcatgtggttcaattcgacgcaacgcgcagaaccttaccagcccttgacatgtgactcgccggctccagagacggagccttcggttcggccggagtcagcacaggtgctgcatggctgtcgtcagctcgtgtcgtgagatgttgggttaagtcccgcaacgagcgcaaccctcgtctccagttgccatcaggttatgctgggcactttggagaaactgccggtgacaagccggaggaaggtggggatgacgtcaagtcctcatggcccttacgggctgggctacacacgtgctacaatggcggtgacagtgggatgcgaaggggcgacccggagccgatccccaaaaaccgtcccagttcggattgcactctgcaactcgagtgcatgaagttggaatcgctagtaatcgcggatcagcatgccgcggtgaatacgttcccgggccttgtacacaccgcccgtcacgccatgggagttggttctacccgaaaacggtgcgctaaccgcaaggaggcagccggtcacggtaggatcaatgactggggcgaagtcgtaacaaggtagccgtaggggaacctgcggctggatcacctcctttctaaggaag

SEQ ID NO: 7805 - DNA, 1502 bp, Rhodospirillaceae bacterium Gri0909
  ref <308>: DATABASE ACCESSION NUMBER: NCBI ACCESSION: NZ_SADE01000006.1
  ref <309>: DATABASE ENTRY DATE: 2019-04-01
  ref <313>: RELEVANT RESIDUES IN SEQ ID NO: (1)..(1502)
gaacttgagagtttgatcctggctcagaacgaacgctggcggcaggcctaacacatgcaagtcgagcgagaaggatccttcgggatctggagagcggcggacgggtgagtaacgcgtgggaacgtgcccttaggtgggggacaacagttggaaacgactgctaataccgcataagccaatttgggaaagccttcgggcgccttgggatcggcccgcgttagattaggtagttggtggggtaaaggcctaccaagcctacgatctatagctggtttgagagaatgatcagccacactgggactgagacacggcccagactcctacgggaggcagcagtggggaatattgcgcaatgggggaaaccctgacgcagccatgccgcgtgggtgaagaaggccttcgggttgtaaagccctttcaacggtgaagatgatgactgtagccgtagaagaagccccggctaacttcgtgccagcagccgcggtaatacgaagggggctagcgttgttcggaattactgggcgtaaagggcgcgtaggcggactgaccagtcaggggtgaaatcccgaggctcaacctcggaactgcctttgatactgtcagtctagagtctgtgagaggatgacggaatacccagtgtagaggtgaaattcgtagatattgggtagaacaccggtggcgaaggcggtcatctggcgcagcactgacgctgaggcgcgaaagcgtggggagcaaacaggattagataccctggtagtccacgccgtaaacgatgtgtgctagccgtcgggagttaggctctcggtggcgccgctaacgcattaagcacaccgcctggggagtacggtcgcaagattaaaactcaaaggaattgacgggggcccgcacaagcggtggagcatgtggtttaattcgaagcaacgcgcagaaccttaccaacccttgacatgtgaagtttggttagtggagacactttccttcagttcggctggcttcaacacaggtgctgcatggctgtcgtcagctcgtgtcgtgagatgttgggttaagtcccgcaacgagcgcaaccctcacccttagttgccatcatttagttgggcactctaggggaactgccggtgacaagccggaggaaggcggggatgacgtcaagtcctcatggcccttatgggttgggctacacacgtgctacaatggcgactacagagggcagcgaggcggcgacgccaagcgaatcccaaaaagtcgtctcagttcggattgttctctgcaactcgagagcatgaaggcggaatcgctagtaatcgcggatcagcatgccgcggtgaatacgttcccgggccttgtacacaccgcccgtcacaccatgggagttggttttacccgaagacggtgggctaaccgtaaggaagcagccggccacggtaagatcagcgactggggtgaagtcgtaacaaggtagccgtaggggaacctgcggctggatcacctcctttctaagg

SEQ ID NO: 7806 - DNA, 1494 bp, Rhodospirillaceae bacterium HHTR118
  ref <308>: DATABASE ACCESSION NUMBER: NCBI ACCESSION: NZ_QXNY01000012.1
  ref <309>: DATABASE ENTRY DATE: 2019-04-01
  ref <313>: RELEVANT RESIDUES IN SEQ ID NO: (1)..(1494)
aatctgagagtttgatcctggctcagaacgaacgctggcggcaggcctaacacatgcaagtcgaacgcactcttcggagtgagtggcgcacgggtgagtaacgcgtgggaacctgccctggggttgggaataaccgctggaaacggcggctaatacccgatacgcctttcgagggaaagatttatcgccccgggatgggcccgcgtccgattagcttgttggtggggtaatggcccaccaaggcatcgatcggtagctggtctgagaggatgatcagccacactgggactgagacacggcccagactcctacgggaggcagcagtggggaatcttggacaatgggggaaaccctgatccagccatgccgcgtgggtgaagaaggccttagggttgtaaagccctttcagtcgtgacgatgatgacggtagcgacagaagaagccccggctaactccgtgccagcagccgcggtaatacggagggggcaagcgttgttcggatttactgggcgtaaagggcgcgtaggcggatgatcaagtcagaggtgaaaggcccgggctcaacctgggacgtgcctttgaaactgattgtcttgagtgcgggagagggtgacggaattcccagtgtagaggtgaaattcgtagatattgggaagaacaccggtggcgaaggcggtcacctggcccgcaactgacgctgaggcgcgaaagcgtggggagcaaacaggattagataccctggtagtccacgccgtaaacgatgtgcgctagccgttggggctcgtagagtctcggtggcgcagttaacgcgttaagcgcaccgcctggggagtacggccgcaaggttaaaactcaaaggaattgacgggggcccgcacaagcggtggagcatgtggtttaattcgaagcaacgcgcagaaccttaccagcccttgacatggggagtttggtctttggagacgaaggccttcagttcggctggctcccgcacaggtgctgcatggctgtcgtcagctcgtgtcgtgagatgttgggttaagtcccgcaacgagcgcaacccttgtcctcagttgccatcgggtagggccgggcactctggggagactgccggtgacaagccggaggaaggcggggatgacgtcaagtcctcatggcccttatgggctgggctacacacgtgctacaatggcggtgacagtgggcagcgaaggcgcaagccggagcgaatctccaaaagccgtctcagttcggattgcactctgcaactcgggtgcatgaagttggaatcgctagtaatcgtggatcagcatgccacggtgaatacgttcccgggccttgtacacaccgcccgtcacaccatgggagttggtttgacccgaagccggtgcgctaaccgtaaggaggcagccgaccacggtcaggtcagcgactggggtgaagtcgtaacaaggtagccgtaggggaacctgcggctggatcacctcctttctaagg

SEQ ID NO: 7807 - DNA, 1530 bp, Rhodospirillaceae bacterium SYSU D60006
  ref <308>: DATABASE ACCESSION NUMBER: NCBI ACCESSION: NZ_QORV01000028.1
  ref <309>: DATABASE ENTRY DATE: 2019-04-01
  ref <313>: RELEVANT RESIDUES IN SEQ ID NO: (1)..(1530)
tttacggagagtttgatcctggctcaggacgaacgctggcggcgtgcttaacacatgcaagtcgaacgatgaagcccagcttgctgggtggaagagtggcgaacgggtgagtaacacgtgagtaacctgccctgaactctgggataagcactggaaacggtgtctaatactggatacgacctatcaccgcatggtgtgtaggtggaaagatttatcggttctggatggactcgcggcctatcagctagatggtgaggtaatggctcaccatggcgacgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggcttgtcgcgtctgctgtgaaatcccggggctcaaccccgggcctgcagtgggtacgggcaagctagagtgcggtaggggagattggaattcctggtgtagcggtggaatgcgcagatatcaggaggaacaccgatggcgaaggcagatctctgggccgctactgacgctgaggagcgaaagcatggggagcgaacaggattagataccctggtagtccatgccgtaaacgttgggaactagatgtagggcctgttccacgggttctgtgtcgtagctaacgcattaagttccccgcctggggagtacggccgcaaggctaaaactcaaaggaattgacgggggcccgcacaagcggcggagcatgcggattaattcgatgcaacgcgaagaaccttaccaaggcttgacataaccgagaacgctgtagagatacagaactctttggacactcggttacaggtggtgcatggttgtcgtcagctcgtgtcgtgagatgttcggttaagtccggcaacgagcgcaaccctcgtcctatgttgccagcacgttatggtgggaactcatgggatactgccgtggtcaacacggaggaaggtggggatgacgtcaaatcatcatgccccttatgtcttgggcttcacgcatgctacaatggccgatacaaagggctgcgataccgcgaggtggagcgaatcccaaaaagtcggtctcagttcggattggggtctgcaactcgaccccatgaagtcggagtcgctagtaatcgcagatcagcaacgctgcggtgaatacgttcccgggccttgtacacaccgcccgtcaagtcatgaaagtcggtaacacccgaagccggtggcctaacccttgtggagggagccgtcgaaggtgggactggtgattaggactaagtcgtaacaaggtagccgtaccggaaggtgcggctggatcacctcctttctaagga

SEQ ID NO: 7808 - DNA, 1504 bp, Rhodospirillaceae bacterium SYSU D60007
  ref <308>: DATABASE ACCESSION NUMBER: NCBI ACCESSION: NZ_QOCQ01000049.1
  ref <309>: DATABASE ENTRY DATE: 2019-04-01
  ref <313>: RELEVANT RESIDUES IN SEQ ID NO: (1)..(1504)
ttgaacatgagagtttgatcctggctcagaacgaacgctggcggcaggcctaacacatgcaagtcgagcgggcgcagcaatgcgtcagcggcgcacgggtgagtaacgcgtgggaacctgccctttggttcggaacaaccctgggaaactagggctgataccggatgagccctgatcgcgagattgggggaaagatttatcgccgaaggaggggcccgcgtccgattagctagttggtggggtaacggcctaccaaggctgcgatcggtagccggtctgagaggacgatcggccacactgggactgagacacggcccagactcctacgggaggcagcagtggggaatattggacaatgggcgcaagcctgatccagccatgccgcgtgggtgatgaaggccttcgggttgtaaagcccttttggcggggacgatgatgacggtacccgcagaataagccccggctaacttcgtgccagcagccgcggtaagacgaagggggcaagcgttgttcggaattactgggcgtaaagggcgcgtaggcggcctgtttagtcagccgtgaaaggcctgggctcaacctgggaattgcggttgatactggcgggctggagagcgggagaggatggtggaattcccagtgtagaggtgaaattcgtagatattgggaagaacaccggtggcgaaggcggccatctggaccgtatctgacgctgaggcgcgaaagcgtggggagcaaacaggattagataccctggtagtccacgctgtaaacgatgagtgctggacgttggcgggcttgcctgccggtgtcgcagctaacgcgttaagcactccgcctggggagtacggccgcaaggttgaaactcaaaggaattgacgggggcccgcacaagcggtggagcatgtggtttaattcgacgcaacgcgcagaaccttaccagcccttgacatgccgtgttagccgcagagatgcggggttcccttcggggacgcggacacaggtgctgcatggctgtcgtcagctcgtgtcgtgagatgttgggttaagtcccgcaacgagcgcaaccctcgtctccagttgccatcgggtcgagccgggcactttggagaaactgccggtgacaagccggaggaaggtggggatgacgtcaagtcctcatggcccctacgggctgggctacacacgtgctacaatggcggtgacagaggggagcgaggcagcgatgccgagccgatctcgaaaagccgtctcagttcggattgcgctctgcaactcgggcgcatgaaggtggaatcgctagtaatcgcggatcagcatgccgcggtgaatacgttcccgggccttgtacacaccgcccgtcacaccatgggagttggttctacccgaaggcgctgcgccgacccgaaaggggggcaggcgaccacggtaggatcagcgactggggtgaagtcgtaacaaggtagccgtaggggaacctgcggctggatcacctcctttctaa

SEQ ID NO: 7809 - DNA, 1501 bp, Rhodospirillaceae bacterium SYSU D60009
  ref <308>: DATABASE ACCESSION NUMBER: NCBI ACCESSION: NZ_QORW01000039.1
  ref <309>: DATABASE ENTRY DATE: 2019-04-01
  ref <313>: RELEVANT RESIDUES IN SEQ ID NO: (1)..(1501)
aacctgagagtttgatcctggctcagaacgaacgctggcggcatgcctaacacatgcaagtcgaacgggatccatccttcggggtggtgagagtggcggacgggtgagtaacgcgtgggaacctgcccagtggtgggggataactgcgggaaactgcagctaataccgcatgagcccgagaggggaaagatttatcgccattggaggggcccgcgttcgattaggtagttggtggggtaatggcccaccaagccgacgatcgatagctggtctgagaggatgatcagccacactgggactgagatacggcccagactcctacgggaggcagcagtggggaatattggacaatgggggcaaccctgatccagcaatgccgcgtgagtgatgaaggccttcgggttgtaaagctcttttgccagggacgatgatgacggtacctggagaataagccccggctaacttcgtgccagcagccgcggtaatacgaagggggcaagcgttgttcggaattactgggcgtaaagggcgcgtaggcggctcatcaagtcaggcgtgaaattcccgggctcaacctgggggctgcgcttgatactgatgggcttgaatgcgggagaggatagtggaattcccagtgtagaggtgaaattcgtagatattgggaagaacaccggtggcgaaggcggctatctggcccgtgattgacgctgaggcgcgaaagcgtggggagcaaacaggattagataccctggtagtccacgccgtaaacgatgaatgctagacgttggcgagcatgctcgtcagtgtcggagctaacgcattaagcattccgcctggggagtacggtcgcaagattaaaactcaaaggaattgacgggggcccgcacaagcggtggagcatgtggtttaattcgaagcaacgcgcagaaccttaccaacccttgacatggggagtatgggctggagagatccggtccttcagttcggctggctcccacacaggtgctgcatggctgtcgtcagctcgtgtcgtgagatgttgggttaagtcccgcaacgagcgcaacccctatcttcagttgccatcatttggttgggcactctgaagaaactgccggtgacaagccggaggaaggcggggatgacgtcaagtcctcatggcccttacgggttgggctacacacgtgctacaatggtggtgacaatggggagcgaggccgcgaggccaagccaatctcaaaaagccatctcagttcggattgcactctgcaactcgagtgcatgaagttggaatcgctagtaatcgcgcatcagcatggcgcggtgaatacgttcccgggccttgtacacaccgcccgtcacaccatgggagttggttttacccgaagccggtgtgcgaaccgcaaggatgcagccgaccacggtaaggtcagcgactggggtgaagtcgtaacaaggtagccgtaggggaacctgcggctggatcacctcctttctaagg

SEQ ID NO: 7810 - DNA, 1518 bp, Rhodospirillaceae bacterium SYSU D60014
  ref <308>: DATABASE ACCESSION NUMBER: NCBI ACCESSION: NZ_QOZR01000027.1
  ref <309>: DATABASE ENTRY DATE: 2019-04-01
  ref <313>: RELEVANT RESIDUES IN SEQ ID NO: (1)..(1518)
aacctgagagtttgatcctggctcagaacgaacgctggcggcatgcttaacacatgcaagtcgaacgggatccggggcttcggccccggtgagagtggcggacgggtgagtaacgcgtgggaacctgcccagtggtggggaataaccgcgggaaactgcggctaataccccatacgcccttggccttcgggcccgggggaaagatttatcgccattggaggggcccgcgtcggattaggtagttggtggggtaatggcctaccaagcctgcgatccgtagctggtctgagaggatgatcagccacactgggactgagatacggcccagactcctacgggaggcagcagtggggaatattggacaatgggcgcaagcctgatccagcaatgccgcgtgagtgaagaaggccttagggttgtaaagctctttcgcccgcgacgatgatgacggtagcgggagaagaagccccggctaactccgtgccagcagccgcggtaatacggagggggctagcgttgttcggaattactgggcgtaaagggcgcgtaggcggcgctccaagtcaggcgtgaaagtcccgggctcaacccggggacggcgcttgagactggggtgctcgagtccgggagaggatggcggaattcccagtgtagaggtgaaattcgtagatattgggaagaacaccggtggcgaaggcggccatctggaccggcactgacgctgaggcgcgaaagcgtggggagcaaacaggattagataccctggtagtccacgccgtaaacgatgtgtgctagacgtcggggggcttgcccttcggtgtcgtcgctaacgctttaagcacaccgcctggggagtacggtcgcaagattaaaactcaaaggaattgacgggggcccgcacaagcggtggagcatgtggtttaattcgaagcaacgcgcagaaccttaccagcccttgacatgggcgtcgcgggggccagagatggcctccttcagttcggctggacgccacacaggtgctgcatggctgtcgtcagctcgtgtcgtgagatgttgggttaagtcccgcaacgagcgcaacccctatcttcagttgccagcggttcggccgggcactctggagaaactgccggtgacaagccggaggaaggcggggatgacgtcaagtcctcatggcccttacgggctgggctacacacgtgctacaatggcggtgacaatgggccgcgaaggggcgacccggagccaatcccaaaaaaccgtctcagttcggattgcactctgcaactcgggtgcatgaagttggaatcgctagtaatcgcggatcagcatgccgcggtgaatacgttcccgggccttgtacacaccgcccgtcacaccatgggagttggtttgacccgaagccggtgcgctaacccgcaaggggggcagccgaccacggtcaggtcagcgactggggtgaagtcgtaacaaggtagccgtaggggaacctgcggctggatcacctcctttctaagg

SEQ ID NO: 7811 - DNA, 1508 bp, Rhodospirillaceae bacterium SYSU D60015
  ref <308>: DATABASE ACCESSION NUMBER: NCBI ACCESSION: NZ_QOZS01000110.1
  ref <309>: DATABASE ENTRY DATE: 2019-04-01
  ref <313>: RELEVANT RESIDUES IN SEQ ID NO: (1)..(1508)
gaacctgagagtttgatcctggctcagaacgaacgctggcggcaggcctaacacatgcaagtcgaacgcccgtagcaatacgggagtggcgcacgggtgagtaacgcgtgggaacctaccctttggttcgggacaacccagggaaacttgggctaataccggatgagctggccgggcaactggtcaggaaagattcatcgccgaaggcggggcccgcgtcggattaggtagttggtgaggtaacggctcaccaagcctgcgatccgtagccggtctgagaggatgatcggccacactgggactgagacacggcccagactcctacgggaggcagcagtggggaatattggacaatgggggcaaccctgatccagccatgccgcgtgggtgatgaaggccttagggttgtaaagccctttcgcgcgcgacgatgatgacggtagcgcgagaagaagcctcggctaactccgtgccagcagccgcggtaagacggaggaggctagcgttgttcggaattactgggcgtaaagcgtgcgtaggcggccctgttagtcggaggtgaaatcccggagctcaactccggaactgcctccgagacggccgggcttgagtgaaggagaggagagcggaattcccagtgtagaggtgaaattcgtagatattgggaagaacaccggtggcgaaggcggctctctggcctttttctgacgctgaggcacgaaagcgtggggagcaaacaggattagataccctggtagtccacgccgtaaacgatggatgctggatgtcggggggcttgcccctcggtgtcgaagccaacgcgataagcatcccgcctggggagtacggccgcaaggttaaaactcaaaggaattgacgggggcccgcacaagcggtggagcatgtggtttaattcgaagcaacgcgcagaaccttaccagctcttgacatggggagtatgggccgcggagacgtggtccttcagttcggctggctcccgcacaggtgctgcatggctgtcgtcagctcgtgtcgtgagatgttgggttaagtcccgcaacgagcgcaaccctcgccttcagttgccagcaggtgaagctgggcactctgaaggaaccgccggtgacaagccggaggaaggtggggatgacgtcaagtcctcatggcccttacgggctgggctacacacgtgctacaatggcggtgacagaggggtgcgaaggggcgacccggagccgatcccgaaaagccgtctcagttcggattgcactctgcaactcgggtgcatgaagtcggaatcgctagtaatcgtggatcagcacgccacggtgaatacgttcccgggccttgtacacaccgcccgtcacaccatgggagttggttttaccttaagccggtgcacgaacccgcaaggggcgtagccgaccacggtaaggtcagcgactggggtgaagtcgtaacaaggtagccgtaggggaacctgcggctggatcacctcctttctaagg

SEQ ID NO: 7812 - DNA, 1495 bp, Rhodospirillales bacterium URHD0088
  ref <308>: DATABASE ACCESSION NUMBER: NCBI ACCESSION: NZ_JADL01000008.1
  ref <309>: DATABASE ENTRY DATE: 2019-04-01
  ref <313>: RELEVANT RESIDUES IN SEQ ID NO: (1)..(1495)
gaacctgagagtttgatcctggctcagaacgaacgctggcggcatgcctaacacatgcaagtcgaacgcctatagcaatataggagtggcgcacgggtgagtaacgcgtgggaacctgccccgaggtgggggataaccgatggaaacgtcggctaataccgcatacgacctgagggtgaaagatttatcgccttgggaggggcccgcgtcggattagctagttggtggggtaatggcctaccaaggcgatgatccgtagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctctttcggcggggacgatgatgacggtacccgcagaagaagccccggctaacttcgtgccagcagccgcggtaatacgaagggggcaagcgttgttcggaattactgggcgtaaagggcgcgcaggcggcctgccaagtcagatgtgaaagccccgggctcaacctgggaatagcatttgggactggtgggctagagatcgggagaggagagtggaattcccagtgtagaggtgaaattcgtagatattgggaagaacaccggtggcgaaggcggctctctggaccgatactgacgctgaggcgcgaaagcgtggggagcaaacaggattagataccctggtagtccacgctgtaaacgatgtgtgctagacgttggggagcctagctcttcggtgtcgcagctaacgctttaagcacaccgcctggggagtacggccgcaaggttaaaactcaaaggaattgacgggggcccgcacaagcggtggagcatgtggtttaattcgacgcaacgcgaagaaccttaccagcccttgacatgggaagtttgggcgtcagagatggcgtccttcagttcggctggcttccgcacaggtgctgcatggctgtcgtcagctcgtgtcgtgagatgttgggttaagtcccgcaacgagcgcaaccctcgtcttcagttgccatcgggttatgccgggcactctgaagaaactgccggtgataagccggaggaaggcggggatgacgtcaagtcctcatggcccttatgggctgggctacacacgtgctacaatggcggtgacagagggatgcgaaggagcgatccttagccaatctcgaaaagccgtctcagttcggattgctctctgcaactcgagagcatgaagttggaatcgctagtaatcgcggatcagcatgccgcggtgaatacgttcccgggccttgtacacaccgcccgtcacaccatgggagttggttttacccgaaggcggtgcgccaaccgtaaggaggcagccgaccacggtaaggtcagcgactggggtgaagtcgtaacaaggtagccgtaggggaacctgcggctggatcacctcctttctgg

SEQ ID NO: 7813 - DNA, 1494 bp, Rhodospirillum centenum
  ref <308>: DATABASE ACCESSION NUMBER: NCBI ACCESSION: NC_011420.2
  ref <309>: DATABASE ENTRY DATE: 2019-04-01
  ref <313>: RELEVANT RESIDUES IN SEQ ID NO: (1)..(1494)
tcaaacctgagagtttgatcctggctcagaacgaacgctggcggcaggcctaacacatgcaagtcgaacgaaggcttcggccttagtggcggacgggtgagtaacacgtgggaacgtgcccttgggttcgggataacgtctggaaacggacgctaataccggatgtcccctgcgggggaaagatttatcgcctgaggagcggcccgcgtccgattagctagatggtggggtaaaggcctaccatggcgacgatcggtagctggtctgagaggatgatcagccacactgggactgagacacggcccagactcctacgggaggcagcagtggggaatattggacaatgggcggaagcctgatccagccatgccgcgtgagtgatgaaggccttcgggttgtaaagctctttcgcacgcgacgatgatgacggtagcgtgagaagaagccccggctaacttcgtgccagcagccgcggtaatacgaagggggctagcgttgttcggaattactgggcgtaaagggcgcgtaggcggcctttcaagtcaggcgtgaaagccccgggctcaacctgggaactgcgcttgagactgtgaggcttgaggtccggagaggtgggtggaattcccagtgtagaggtgaaattcgtagatattgggaagaacaccggtggcgaaggcggcccactggacggatactgacgctgaggcgcgaaagcgtggggagcaaacaggattagataccctggtagtccacgccgtaaacgatgtcggctagacgttggggctcttagagcttcggtgtcgcagctaacgcattaagccgaccgcctggggagtacggccgcaaggttgaaactcaaaggaattgacgggggcccgcacaagcggtggagcatgtggtttaattcgaagcaacgcgcagaaccttaccaacccttgacatgccagggccgccccagagatggggttttcccttcggggacctggacacaggtgctgcatggctgtcgtcagctcgtgtcgtgagatgttgggttaagtcccgcaacgagcgcaacccccactgtcagttgccatcattaagttgggcactctggcagaactgccggtgacaagccggaggaaggcggggatgacgtcaagtcctcatggcccttacgggttgggctacacacgtgctacaatggtggtgacagtgggcagcgaccacgcgagtggaagcgaatctccaaaagccatctcagttcggattgcactctgcaactcgggtgcatgaagttggaatcgctagtaatcgcggatcagcacgccgcggtgaatacgttcccgggccttgtacacaccgcccgtcacaccatgggagttggctttacccgaagccggtgcgctaaccgcaaggaggcagccgaccacggtacggtcagcgactggggtgaagtcgtaacaaggtagccgtaggggaacctgcggctggatcacctcctttctaaggaaa

SEQ ID NO: 7814 - DNA, 1502 bp, Rhodospirillum rubrum
  ref <308>: DATABASE ACCESSION NUMBER: NCBI ACCESSION: NC_017584.1
  ref <309>: DATABASE ENTRY DATE: 2019-04-01
  ref <313>: RELEVANT RESIDUES IN SEQ ID NO: (1)..(1502)
ggctttcgagatcaacttgagagtttgatcctggctcaggacgaacgctggcggcaggcctaacacatgcaagtcgaacgcatccttcgggatgagtggcgcacgggtgagtaacacgtgggaacgtaccttggagtgcggaataatctttggaaacgaggactaataccgcatacgcccttagggggaaagatttatcgctccaagatcggcccgcgtccgattagctagttggcggggtaatggcccaccaaggcgacgatcggtagctggtctgagaggatggccagccacactgggactgagacacggcccagactcctacgggaggcagcagtggggaatattgcgcaatgggggcaaccctgacgcagccatgccgcgtgagtgaagaaggccttcgggttgtaaagctctttcgggtgtgaagatgatgacggtaacaccagaagaagccccggctaacttcgtgccagcagccgcggtaatacgaagggggcaagcgttgttcggaattactgggcgtaaagagcgcgtaggcggtctgattagtcagaggtgaaatcccagagctcaactttggaactgcctttgatactgttagactagaatccgtgagagggtggtggaattcccagtgtagaggtgaaattcgtagatattgggaggaacaccagtggcgaaggcggccacctggcgcggtattgacgctgaggcgcgaaagcgtggggagcaaacaggattagataccctggtagtccacgccgtaaacgatgagtgctagatgtcggggtacatgtacctcggtgtcgcagctaacgcattaagcactccgcctggggagtacggccgcaaggttaaaactcaaaggaattgacgggggcccgcacaagcggtggagcatgtggtttaattcgaagcaacgcgcagaaccttaccagcccttgacatcccgtgacacttccagagatggaaggttcccttcggggacacggtgacaggtgctgcatggctgtcgtcagctcgtgtcgtgagatgttgggttaagtcccgcaacgagcgcaaccctcatcttcagttgccagcaagtaacgttgggcactctgaagagactgccggtgacaagccggaggaaggtggggatgacgtcaagtcctcatggcccttacgggctgggctacacacgtgctacaatggcgcctacaatgggcagcgacctcgcgaggggaagctaatctccaaaaggcgtctcagttcggattgcactctgcaactcgggtgcatgaagtcggaatcgctagtaatcgtggatcagcatgccacggtgaatacgttcccgggccttgtacacaccgcccgtcacaccatgggagttggttctacccgaagacggtacgctaaccgcaaggaggcagccggccacggtagggtcagcgactggggtgaagtcgtaacaaggtagccgtaggggaacctgcggctggatcacctcctttcaagga

SEQ ID NO: 7815 - DNA, 1532 bp, Rhodothermaceae bacterium RA
  ref <308>: DATABASE ACCESSION NUMBER: NCBI ACCESSION: NZ_CP020382.1
  ref <309>: DATABASE ENTRY DATE: 2019-04-01
  ref <313>: RELEVANT RESIDUES IN SEQ ID NO: (1)..(1532)
ttactatggagagtttgatcctggctcaggacgaacgctggcggcgggcttaacacatgcaagtcgaacgtgaagccaccttcgggtggtggaaagtggcgcacgggtgcgtaacgcgtaggcaacctgcccttagctgggggataaccatcggaaacggtggctaataccgcatgaaatcttcgggtcgcatgatctggagatcaaagctcaggcggctaaggatgggcctgcgtcggattagctagttggtgaggtaacggctcaccaaggcgacgatccgtagctggtctgagaggatgatcagccacactggcactgagacacgggccagactcctacgggaggcagcagtgaggaatattgcgcaatgggcgaaagcctgacgcagccacgccgcgtggaggaagacacccctatggggcgtaaactccttttctgtgagaagaaaccccgggttgcccgggctgacggtatcacaggaataagcaccggctaactccgtgccagcagccgcggtaatacggagggtgcaagcgttgtccggaatcactgggtgtaaagggtgtgtaggtgggtctgtaagtcagaggtgaaagcctgcggcttaaccgtagaattgcctttgatactgcagatcttgagtcctggagaggccgccggaattcgtggtgtagcggtgaaatgcgtagatatcacgaggaacaccagaggcgtaggcgggtggctggacaggtactgacactgaggcacgaaagcgtggggagcaaacaggattagataccctggtagtccacgccgtaaacgatggatgctcgatgctgcggcgcttttgctgcagtgtccaagctaacgcattaagcatcccacctggggagtacgctcgcaagagtgaaactcaaaggaattgacgggggcccgcacaagcggtggagcatgtggcttaattcgatgcaacgcgaagaaccttacctgggctcgaacgctaccggacagcccctgaaagggggtctccttcgggctggtagtgaggtgctgcatggctgtcgtcagttcgtgtcgtgagatgttgggttaagtcccgcaacgaacgcaacccctatcgctagttaccagcgggtcatgccggggactctagcgagactgcctgcgcaagcagtgaggaaggtggggatgacgtcaagtcatcatggcccttatgcccagggctgcacacgtgctacaatgggtgatacagtgggcagccactccgcgaggaggcgcgaatccccaaagtcactctcagttcggattgcagtctgcaactcgactgcatgaagccggaatcgctagtaatcgcgtatcagctacgacgcggtgaatacgttcccgggccttgtacacaccgcccgtcaagccatggaagctgagggggcccgaagtccgtgacccaacccgtaagggagggagcggccgaaggtcaacttagtgactggggctaagtcgtaacaaggtagccgtaccggaaggtgcggctggatcacctcctaaag

SEQ ID NO: 7816 - DNA, 1544 bp, Rhodothermus marinus
  ref <308>: DATABASE ACCESSION NUMBER: NCBI ACCESSION: NZ_AGIV01000001.1
  ref <309>: DATABASE ENTRY DATE: 2019-04-01
  ref <313>: RELEVANT RESIDUES IN SEQ ID NO: (1)..(1544)
ttactacggagagtttgatcctggctcagggcgaacgctggcggcgggcctaacacatgcaagtcgtacgcggggttctccttcgggagaactgccgagtggcgaacgggtgcgtaacgcgtaggtaacctgccctcgagtgggggataactccgggaaaccggggctaataccgcatattgtcccgggaccgcatggctccgggatgaaagccctctgggcgctcgaggatgggcctgcgtcggattagctagttggtggggtaacggcccaccaaggcgacgatccgtagctggtctgagaggacgaccagccacactggcactgagacacgggccagactcctacgggaggcagcagtggggaatcttgggcaatgggcgaaagcctgacccagccacgccgcgtggaggatgaagcccttcggggtgtaaactccttttctgggggaagaaatcccgacgctggtcgggactgacggtaccccaggaataagcgccggctaactccgtgccagcagccgcggtaatacggagggcgcaagcgttgcccggaatcactgggtgtaaagggtgcgtaggcggggctgtaagtcagaggtgaaagcccccggctcaaccggggaattgcctctgatactgcagctcttgagtcccggagaggccgctggaattcctggtgtagcggtgaaatgcgtagatatcaggaggaacaccagaggcgaaggcgggcggctggacggggactgacgctgaggcacgaaagcgtggggagcaaacaggattagataccctggtagtccacgccgtaaacgatggatgctcggcgttgtcgccttcgggtggcagtgcctaagctaacgcgttaagcatcccacctggggagtacggccgcaaggctgaaactcaaaggaattgacgggggcccgcacaagcggtggagcatgtggcttaattcgatgctacgcgaggaaccttacctgggctcgaacaccaccggacagcccccgaaagggggtctcccgcaagggctggtggtgaggtgctgcatggctgtcgtcagctcgtgccgtgaggtgttgggttaagtcccgcaacgagcgcaacccctaccgccagttaccagcgggtaatgccggggactctggcgggactgcctgcgcaagcaggaggaaggtggggatgacgtcaagtcatcatggcccttacgcccagggctgcacacgtgctacaatggccggtacaatgggcagccaccccgcgagggggagcgaatccctaaagccggtctcagttcggattggagtctgcaactcgactccatgaagccggaatcgctagtaatcgcgcatcagctacggcgcggtgaatacgttcccgggccttgtacacaccgcccgtcaacccatgggagccgggggcgcccgaagtccgtgacccaacccgcttcggcgggagggagcggcctaaggcgaacccggtgactgggggtaagtcgtaacaaggtagccgtacgggaacgtgcggctggatcacctcctaaag

SEQ ID NO: 7817 - DNA, 1544 bp, Rhodothermus profundi
  ref <308>: DATABASE ACCESSION NUMBER: NCBI ACCESSION: NZ_FRAU01000004.1
  ref <309>: DATABASE ENTRY DATE: 2019-04-01
  ref <313>: RELEVANT RESIDUES IN SEQ ID NO: (1)..(1544)
ttactacggagagtttgatcctggctcagggcgaacgctggcggcgggcctaacacatgcaagtcgtacgcggggccctccttcgggagggctgccgagtggcgaacgggtgagtaacgcgtaggtaacctgccctcgagtgggggataaccccgggaaaccggggctaataccgcatattgtcccggggccgcatggtgccgggatgaaagccctctgggcgctcgaggatgggcctgcgtcggattagctagttggtggggtaacggcccaccaaggcgacgatccgtagctggtctgagaggacggccagccacactggcactgagacacgggccagactcctacgggaggcagcagtggggaatcttgggcaatgggcgaaagcctgacccagccacgccgcgtggaggatgaagcccttcggggtgtaaactccttttctgggggaagaaaccccgactctggtcggggctgacggtaccccaggaataagcgccggctaactccgtgccagcagccgcggtaatacggagggcgcaagcgttgcccggaatcactgggtgtaaagggtgcgtaggcggggctgtaagtcagaggtgaaagccctcggctcaaccgaggaattgcctctgatactgcagctcttgagtcccggagaggccgctggaattcctggtgtagcggtgaaatgcgtagatatcaggaggaacaccggaggcgaaggcgggcggctggacggggactgacgctgaggcacgaaagcgtggggagcaaacaggattagataccctggtagtccacgccgtaaacgatggatgctcggcgttgccgccttcgggcggcagtgcctaagctaacgcggtaagcatcccacctggggagtacggccgcaaggttgaaactcaaaggaattgacgggggcccgcacaagcggtggagcatgtggcttaattcgatgctacgcgaggaaccttacctgggctcgaacaccaccggacagcccccgaaagggggtctcccgaaagggctggtggtgaggtgctgcatggctgtcgtcagctcgtgccgtgaggtgttgggttaagtcccgcaacgagcgcaacccctgccgccagttaccagcgggtaatgccggggactctggcgggactgcctgcgcaagcaggaggaaggtggggacgacgtcaagtcatcatggcccttatgcccagggctgcacacgtgctacaatggccggtacaatgggcagccaccccgcgagggggagcgaatccctaaagccggtctcagttcggattggagtctgcaactcgactccatgaagccggaatcgctagtaatcgcgcatcagctacggcgcggtgaatacgttcccgggccttgtacacaccgcccgtcaacccatgggagccgggggcacccgaagtccgtaacccaacccgcttcggcgggagggagcggcctaaggtgaacccggtgactgggggtaagtcgtaacaaggtagccgtacgggaacgtgcggctggatcacctcctaaag

SEQ ID NO: 7818 - DNA, 1493 bp, Rhodovarius sp. CCP-6
  ref <308>: DATABASE ACCESSION NUMBER: NCBI ACCESSION: NZ_SACL01000023.1
  ref <309>: DATABASE ENTRY DATE: 2019-04-01
  ref <313>: RELEVANT RESIDUES IN SEQ ID NO: (1)..(1493)
atgaacctgagagtttgatcctggctcagagtgaacgctggcggcatgcttaacacatgcaagtcgcacggaggcttcggccttagtggcggacgggtgagtaacgcgtaggaacgtatccacgggtgggggataacgctgggaaactggcgctaataccgcatgatgcctgagggccaaagctttagcgcctgtggagcggcctgcgtacgattagcttgttggtggggtaaaggcctaccaaggctacgatcgttagctggtctgagaggacgatcagccacactgggactgagacacggcccagactcctacgggaggcagcagtggggaatattggacaatgggcgcaagcctgatccagcaatgccgcgtgggtgaagaaggtcttcggattgtaaagccctttcgacagggacgatgatgacggtacctgtagaagaagccccggctaacttcgtgccagcagccgcggtaatacgaagggggctagcgttactcggaatgactgggcgtaaagggcgcgtaggctgtttggtaagttgggcgtgaaattcctgggcttaacctgggggctgcgtccaagactgcctgacttgaggatggaagaggctcgtggaattcccagtgtagaggtgaaattcgtagatattgggaagaacaccggtggcgaaggcggcgagctggtccattactgacgctgaggcgcgatagcgtggggagcaaacaggattagataccctggtagtccacgccgtaaacgatgtgtgctggatgttggggttcctagaacttcagtgtcgtagctaacgcgataagcacaccgcctggggagtacggccgcaaggttgaaactcaaaggaattgacgggggcccgcacaagcggtggagcatgtggtttaattcgaagcaacgcgcagaaccttaccagggcttgacatgggtaggcttgattcagagatggatcttccccgcaaggggcctgccgcacaggtgctgcatggctgtcgtcagctcgtgtcgtgagatgttgggttaagtcccgcaacgagcgcaaccctctcctctagttgccatcaggtttggctgggcactctagaggtactgccggtgacaagccggaggaaggtggggatgacgtcaagtcctcatggcccttatgtcctgggctacacacgtgctacaatggcggtgacagtgggatgccaggtcgcgaggccgagcggatcccaaaaagccgtctcagttcggattgcactctgcaactcgggtgcatgaaggtggaatcgctagtaatcgcggatcagcatgccgcggtgaatacgttcccgggccttgtacacaccgcccgtcacaccatgggagttggttctaccttaagtggctgcgctaaccgcaagggggcaggtcaccacggtagggtcagcgactggggtgaagtcgtaacaaggtagccgtaggggaacctgcggctggatcacctcctttcaag

SEQ ID NO: 7819 - DNA, 1505 bp, Rhodovibrio salinarum
  ref <308>: DATABASE ACCESSION NUMBER: NCBI ACCESSION: NZ_KI911559.1
  ref <309>: DATABASE ENTRY DATE: 2019-04-01
  ref <313>: RELEVANT RESIDUES IN SEQ ID NO: (1)..(1505)
gaggtcaacctgagagtttgatcctggctcagaacgaacgctggcggcaggcctaacacatgcaagtcgaacggggaccttcgggtcttacgtggcgcacgggtgagtaacgcgtgggaatctaccctaaagtcggggataaccgctggaaacggcggctaataccggatacgccctgaggggcaaagcttttgcgctttaggaggagcccgcgtccgattagctagttggtggggtaaaggcctaccaaggctgcgatcggtagctggtctgagaggatgatcagccacactgggactgagacacggcccagactcctacgggaggcagcagtggggaatcttggacaatgggggcaaccctgatccagccatgccgcgtgggtgaagaaggccttagggttgtaaagccctttcggcggggaagatgatgacggtacccgcagaagaagccccggctaactccgtgccagcagccgcggtaatacggagggggctagcgttgttcggaatcactgggcgtaaagggcgcgtaggcggaccagcaagtcaggggtgaaagccctgggctcaacctaggaagtgcccttgaaactgcaggtcttgagtccgggagaggagagcggaattcccagtgtagaggtgaaattcgtagatattgggaagaacaccggtggcgaaggcggctctctggaccggcactgacgctgaggcgcgaaagcgtggggagcaaacaggattagataccctggtagtccacgccgtaaacgatgtgcgctagccgttgggcaacctagttgttcagtggcgcagccaacgcattaagcgcaccgcctggggagtacggccgcaaggctaaaactcaaaggaattgacgggggcccgcacaagcggtggagcatgtggtttaattcgaagcaacgcgcagaaccttaccagcccttgacatgtccgtcgcggcctcgggagaccgaggctttcagttcggctggacggaacacaggtgctgcatggctgtcgtcagctcgtgtcgtgagatgttgggttaagtcccgcaacgagcgcaacccctgtccttagttgctatcggttcggccgagcactctagggagactgccggtgacaagccggaggaaggcggggatgacgtcaagtcctcatggcccttatgggctgggctacacacgtgctacaatggcggcgacagagggaagcaagcccgcgagggtgcgcgaatctccaaacgccgtctcagttcggatcgcagtctgcaactcgactgcgtgaagccggaatcgctagtaatcgcggatcagaatgccgcggtgaatacgttcccgggccttgtacacaccgcccgtcacaccatgggagttggctttacccgaagccggtgcgccaacccgcaagggaggcagccgaccacggtaaggtcagcgactggggtgaagtcgtaacaaggtagccgtaggggaacctgcggctggatcacctcctttctaagga

SEQ ID NO: 7820 - DNA, 1473 bp, Rhodovulum imhoffii
  ref <308>: DATABASE ACCESSION NUMBER: NCBI ACCESSION: NZ_QAAA01000038.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcaggcttaacacatgcaagtcgagcgaaggcttcggccttagcggcggacgggtgagtaacgcgtgggaacgtgcccttcactacgggatagtcctgggaaactgggtttaataccgtatacgcccttttggggaaagaatttcggtgaaggatcggcccgcgtctgattaggtagttggtggggtaatggcctaccaagccgacgatcagtagctggtttgagaggatgatcagccacactgggactgagacacggcccagactcctacgggaggcagcagtgaggaatcttggacaatgggggcaaccctgatccagccatgccgcgtgaacgatgaaggccttagggttgtaaagttctttcaccggtgaagataatgacggtagccggagaagaagccccggctaactccgtgccagcagccgcggtaatacggagggggctagcgttgttcggaattactgggcgtaaagcgcacgtaggcggactattaagtcaggggtgaaatcccggggctcaaccccggaactgcctttgatactggtagtctagagttctggagaggtgagtggaattccgagtgtagaggtgaaattcgtagatattcggaggaacaccagtggcgaaggcggctcactggccagatactgacgctgaggtgcgaaagcgtggggagcaaacaggattagataccctggtagtccacgccgtaaacgatgaatgccagacgtcgggcagcatgctgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttttccgagaggaattccttcagttcggctggatcagtgacaggtgctgcatggctgtcgtcagctcgtgtcgtgagatgttcggttaagtccggcaacgagcgcaacccacgtctttagttgccagcagttcggctgggcactctaaagaaactgccgatgataagtcggaggaaggtgtggatgacgtcaagtcctcatggcccttacgggttgggctacacacgtgctacaatggcgatgacaatgggttaatccctaaaagtcgtctcagttcggattgtcctctgcaactcgagggcatgaagtcggaatcgctagtaatcgcgtaacagcatgacgcggtgaatacgttcccgggccttgtacacaccgcccgtcacaccatgggagttgggtttacccgaagacggtgcgccaacctgctcgcaggaggcagccggccacggtaagctcagcgactggggtgaagtcgtaacaaggtagccgtaggggaacctgcggctggatcacctcctttctaa

SEQ ID NO: 7821 - DNA, 1471 bp, Rhodovulum kholense
  ref <308>: DATABASE ACCESSION NUMBER: NCBI ACCESSION: NZ_QAYC01000036.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgaacccttcggggttagcggcggacgggtgagtaacgcgtgggaacgtgcccttctctgcggaataggctcgggaaactgggtttaataccgcatacgcccttcgggggaaagatttatcggagaaggatcggcccgcgtctgattaggtagttggtggggtaatggcctaccaagcctacgatcagtagctggtttgagaggatgatcagccacactgggactgagacacggcccagactcctacgggaggcagcagtgaggaatcttggacaatgggggaaaccctgatccagccatgccgcgtgagcgatgaaggccttagggttgtaaagctctttcagtcgtgaagataatgacggtagcgacagaagaagccccggctaactccgtgccagcagccgcggtaatacggagggggctagcgttgttcggaattactgggcgtaaagcgcgcgtaggcggactattaagtcgggggtgaaatcccggggctcaaccccggaactgcctccgatactggtagtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcggcaagcatgcttgtcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctgatcgcggttacccgagagggtttccttcagttcggctggatcagtgacaggtgctgcatggctgtcgtcagctcgtgtcgtgagatgttcggttaagtccggcaacgagcgcaacccacactcttagttgccagcattcagttgggcactctaagagaactgccgatgataagtcggaggaaggtgtggatgacgtcaagtcctcatggcccttacgggttgggctacacacgtgctacaatggcagtgacaatgggttaatcccaaaaaactgtctcagttcggattgttctctgcaactcgagagcatgaagtcggaatcgctagtaatcgcgtaacagcatgacgcggtgaatacgttcccgggccttgtacacaccgcccgtcacaccatgggagttgggtttacccgaagacggtgcgccaacccttacggggggcagctggccacggtaagctcagcgactggggtgaagtcgtaacaaggtagccgtaggggaacctgcggctggatcacctcctttctaa

SEQ ID NO: 7822 - DNA, 1471 bp, Rhodovulum robiginosum
  ref <308>: DATABASE ACCESSION NUMBER: NCBI ACCESSION: NZ_RWGU01000048.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcttaacacatgcaagtcgagcgaagacttcggtcttagcggcggacgggtgagtaacacgtgggaacatgcccttcactacggaatagtcctgggaaaccgggtttaataccgtatacgcccttcgggggaaagaatttcggtgaaggattggcccgcgtctgattaggtagttggtggggtaatggcctaccaagccgacgatcagtagctggtttgagaggatgatcagccacactgggactgagacacggcccagactcctacgggaggcagcagtgaggaatcttggacaatgggggaaaccctgatccagccatgccgcgtgaacgatgaaggccttagggttgtaaagttctttcaccggtgaagataatgacggtagccggagaagaaaccccggctaactccgtgccagcagccgcggtaatacggagggggttagcgttgttcggaattactgggcgtaaagcgcgcgtaggcggactattaagtcaggggtgaaatcccggggctcaaccccggaactgcctttgatactggtagtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagcatgctgttcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctgatcgcggtttctcgagagagattccttcagttcggctggatcagtgacaggtgctgcatggctgtcgtcagctcgtgtcgtgagatgttcggttaagtccggcaacgagcgcaacccacactcttagttgccagcagttcggctgggcactctaagagaactgccgatgataagtcggaggaaggtgtggatgacgtcaagtcctcatggcccttacgggttgggctacacacgtgctacaatggcagtgacaatgggttaatccccaaaaactgtctcagttcggattgtcctctgcaactcgagggcatgaagtcggaatcgctagtaatcgcgtaacagcatgacgcggtgaatacgttcccgggccttgtacacaccgcccgtcacaccatgggagttgggtttacccgaagacggtgcgccaacctttcgagggggcagctggccacggtaagctcagcgactggggtgaagtcgtaacaaggtagccgtaggggaacctgcggctggatcacctcctttctaa

SEQ ID NO: 7823 - DNA, 1469 bp, Rhodovulum sp. 12E13
  ref <308>: DATABASE ACCESSION NUMBER: NCBI ACCESSION: NZ_QPLK01000029.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcttaacacatgcaagtcgagcgaaggcttcggccttagcggcggacgggtgagtaacgcgtgggaacgtgcccttcactgcggaatagtccttggaaacggggtttaataccgcatacgcccttcgggggaaagaatttcggtgaaggatcggcccgcgtctgattaggtagttggtggggtaacggcctaccaagccgacgatcagtagctggtttgagaggatgatcagccacactgggactgagacacggcccagactcctacgggaggcagcagtggggaatcttagacaatgggggaaaccctgatctagccatgccgcgtgtgtgacgaaggccctagggtcgtaaagcactttcaccggggaagataatgacggtacccggagaagaaaccccggctaactccgtgccagcagccgcggtaatacggagggggttagcgttgttcggaattactgggcgtaaagcgcgcgtaggcgggctgttaagtcgggggtgaaatcccggggctcaaccccggaactgccttcgatactggcagcctagagttcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagacgtcgggcagcatgctgttcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctgatcgcggtttctcgagagagactccttcagttcggctggatcagtgacaggtgctgcatggctgtcgtcagctcgtgtcgtgagatgttcggttaagtccggcaacgagcgcaacccacaccctcagttaccagcggttcggccggggactctgggggaactgcccgtgataagcgggaggaaggtgtggatgacgtcaagtcctcatggcccttacgggttgggctacacacgtgctacaatggcagtgacaatgggttaatcccaaaaagctgtctcagttcggattgtcctctgcaactcgagggcatgaagtcggaatcgctagtaatcgcgtaacagcatgacgcggtgaatacgttcccgggccttgtacacaccgcccgtcacaccatgggagttgggtttacccgaagacggtgcgccaaccttcggggggcagccggccacggtaagctcagcgactggggtgaagtcgtaacaaggtagccgtaggggaacctgcggctggatcacctcctttctaa

SEQ ID NO: 7824 - DNA, 1471 bp, Rhodovulum sp. BSW8
  ref <308>: DATABASE ACCESSION NUMBER: NCBI ACCESSION: NZ_QNVX01000055.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgaacccttcggggttagcggcggacgggtgagtaacgcgtgggaacgtgcccttctctgcggaataggctcgggaaactgggtttaataccgcatacgcccttcgggggaaagatttatcggagaaggatcggcccgcgtctgattaggtagttggtggggtaatggcctaccaagcctacgatcagtagctggtttgagaggatgatcagccacactgggactgagacacggcccagactcctacgggaggcagcagtgaggaatcttggacaatgggggaaaccctgatccagccatgccgcgtgagcgatgaaggccttagggttgtaaagctctttcagtcgtgaagataatgacggtagcgacagaagaagccccggctaactccgtgccagcagccgcggtaatacggagggggctagcgttgttcggaattactgggcgtaaagcgcgcgtaggcggactattaagtcgggggtgaaatcccggggctcaaccccggaactgcctccgatactggtagtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcggcaagcatgcttgtcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctgatcgcggttttccgagaggaattccttcagttcggctggatcagtgacaggtgctgcatggctgtcgtcagctcgtgtcgtgagatgttcggttaagtccggcaacgagcgcaacccacactcttagttgccagcattcagttgggcactctaagagaactgccgatgataagtcggaggaaggtgtggatgacgtcaagtcctcatggcccttacgggttgggctacacacgtgctacaatggcagtgacaatgggttaatcccaaaaaactgtctcagttcggattgttctctgcaactcgagagcatgaagtcggaatcgctagtaatcgcgtaacagcatgacgcggtgaatacgttcccgggccttgtacacaccgcccgtcacaccatgggagttgggtttacccgaagacggtgcgccaacccttacggggggcagctggccacggtaagctcagcgactggggtgaagtcgtaacaaggtagccgtaggggaacctgcggctggatcacctcctttctaa

SEQ ID NO: 7825 - DNA, 1470 bp, Rhodovulum sp. ES.010
  ref <308>: DATABASE ACCESSION NUMBER: NCBI ACCESSION: NZ_FSRS01000001.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcaggcctaacacatgcaagtcgagcgaagccttcgggcttagcggcggacgggtgagtaacgcgtgggaacgtgcccttcactacggaatagtcccgggaaactgggtttaataccgtatacgcccttcgggggaaagaatttcggtgaaggatcggcccgcgtctgattaggtagttggtggggtaatggcctaccaagcctacgatcagtagctggtttgagaggatgatcagccacactgggactgagacacggcccagactcctacgggaggcagcagtgaggaatcttggacaatgggggaaaccctgatccagccatgccgcgtgaacgatgaaggccttagggttgtaaagttctttcgcctgggaagataatgacggtaccaggtaaagaagccccggctaactccgtgccagcagccgcggtaatacggagggggctagcgttgttcggaattactgggcgtaaagcgcgcgtaggcggactattaagtcagaggtgaaatcccagggctcaaccctggaactgcctttgatactggtagtctagagttctggagaggtgagtggaattccgagtgtagaggtgaaattcgtagatattcggaggaacaccagtggcgaaggcggctcactggccagacactgacgctgaggtgcgaaagcgtggggagcaaacaggattagataccctggtagtccacgccgtaaacgatgaatgccagacgtcgggcagcatgctgttcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctggtcgcggtttcccgagagggattccttcagttcggctggaccagtgacaggtgctgcatggctgtcgtcagctcgtgtcgtgagatgttcggttaagtccggcaacgagcgcaacccacactcctagttgccagcattcagttgggcactctaggagaactgccgatgataagtcggaggaaggtgtggatgacgtcaagtcctcatggcccttacgggttgggctacacacgtgctacaatggcagtgacaatgggttaatccccaaaaactgtctcagttcggattgtcctctgcaactcgagggcatgaagtcggaatcgctagtaatcgcgtaacagcatgacgcggtgaatacgttcccgggccttgtacacaccgcccgtcacaccatgggagttgggtttacccgaagacggtgcgccaacccttacgggaggcagctggccacggtaagctcagcgactggggtgaagtcgtaacaaggtagccgtaggggaacctgcggctggatcacctcctttctaa

SEQ ID NO: 7826 - DNA, 1471 bp, Rhodovulum sp. MB263
  ref <308>: DATABASE ACCESSION NUMBER: NCBI ACCESSION: NZ_CP020384.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgaacccttcggggttagcggcggacgggtgagtaacgcgtgggaacgtgcccttctctgcggaataggctcgggaaactgggtttaataccgcatacgcccttcgggggaaagatttatcggagaaggatcggcccgcgttagattaggtagttggtggggtaatggcctaccaagcctacgatctatagctggtttgagaggatgatcagccacactgggactgagacacggcccagactcctacgggaggcagcagtgaggaatcttggacaatgggggaaaccctgatccagccatgccgcgtgagcgatgaaggccttagggttgtaaagctctttcagtcgtgaagataatgacggtagcgacagaagaagccccggctaactccgtgccagcagccgcggtaatacggagggggctagcgttgttcggaattactgggcgtaaagcgcgcgtaggcggactattaagtcaggggtgaaatcccggggctcaaccccggaactgcctttgatactggtagtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcggcaagcatgcttgtcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctgatcgcggttacccgagagggtttccttcagttcggctggatcagtgacaggtgctgcatggctgtcgtcagctcgtgtcgtgagatgttcggttaagtccggcaacgagcgcaacccacactcttagttgccagcattcagttgggcactctaggagaactgccgatgataagtcggaggaaggtgtggatgacgtcaagtcctcatggcccttacgggttgggctacacacgtgctacaatggcagtgacaatgggttaatccccaaaaactgtctcagttcggattgttctctgcaactcgagagcatgaagtcggaatcgctagtaatcgcgtaacagcatgacgcggtgaatacgttcccgggccttgtacacaccgcccgtcacaccatgggagttgggtttacccgaagacggtgcgccaacccttacggggggcagctggccacggtaagctcagcgactggggtgaagtcgtaacaaggtagccgtaggggaacctgcggctggatcacctcctttctaa

SEQ ID NO: 7827 - DNA, 1470 bp, Rhodovulum sp. NI22
  ref <308>: DATABASE ACCESSION NUMBER: NCBI ACCESSION: NZ_JQFU01000090.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcaggcttaacacatgcaagtcgagcgaggacttcggtcttagcggcggacgggtgagtaacgcgtgggaacgtgcccttttctgcggaatagccttgggaaactgagagtaataccgcatacgcccttcgggggaaagatttatcggagaaggatcggcccgcgttagattaggtagttggtggggtaatggcctaccaagccgacgatctatagctggtttgagaggatgatcagccacactgggactgagacacggcccagactcctacgggaggcagcagtgaggaatcttggacaatgggggcaaccctgatccagccatgccgcgtgaacgatgaaggccttagggttgtaaagttctttcaacggtgaagataatgacggtagccgtagaagaaaccccggctaactccgtgccagcagccgcggtaatacggagggggttagcgttgttcggaattactgggcgtaaagcgcacgtaggcggattggaaagttagaggtgaaatcccagggctcaaccctggaactgcctttaaaactcccagtctagagttcgagagaggtgagtggaattgcgagtgtagaggtgaaattcgtagatattcgcaggaacaccagtggcgaaggcggctcactggctcgatactgacgctgaggtgcgaaagcgtggggagcaaacaggattagataccctggtagtccacgccgtaaacgatgaatgccagacgtcggcaagcatgcttgtcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatacctgtcgcggatccagagatggatctttcagttcggctggacaggatacaggtgctgcatggctgtcgtcagctcgtgtcgtgagatgttcggttaagtccggcaacgagcgcaacccacgtctttagttgccagcagttcggctgggcactctaaagaaactgccgatgataagtcggaggaaggtgtggatgacgtcaagtcctcatggcccttacgggttgggctacacacgtgctacaatggcagtgacaatgggttaatccccaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttgggttcacccgaaggccgtgcgccaacctttcgagggggcagcggaccacggtgagctcagcgactggggtgaagtcgtaacaaggtagccgtaggggaacctgcggctggatcacctcctttctaa

SEQ ID NO: 7828 - DNA, 1464 bp, Rhodovulum sp. P5
  ref <308>: DATABASE ACCESSION NUMBER: NCBI ACCESSION: NZ_CP015039.1
  ref <309>: DATABASE ENTRY DATE: 2019-04-01
  ref <313>: RELEVANT RESIDUES IN SEQ ID NO: (1)..(1464)
caacttgagagtttgatcctggctcagaacgaacgctggcggcaggcctaacacatgcaagtcgagcgaagccttcgggcttagcggcggacgggtgagtaacgcgtgggaacgtgcccttcactacggaacagtcccgggaaactgggtttaataccgtatacgccctttgggggaaagaatttcggtgaaggatcggcccgcgttagattaggtagttggtggggtaatggcctaccaagcctacgatctatagctggtttgagaggatgatcagccacactgggactgagacacggcccagactcctacgggaggcagcagtgaggaatcttggacaatgggggcaaccctgatccagccatgccgcgtgaacgatgaaggccttagggttgtaaagttctttcgcctgggaagataatgacggtaccaggtaaagaagccccggctaactccgtgccagcagccgcggtaatacggagggggctagcgttgttcggaattactgggcgtaaagcgcgcgtaggcggactgttaagtcagaggtgaaatcccggggctcaaccccggaactgcctttgatactggcagtctggagttctggagaggtgagtggaattccgagtgtagaggtgaaattcgtagatattcggaggaacaccagtggcgaaggcggctcactggccagacactgacgctgaggtgcgaaagcgtggggagcaaacaggattagataccctggtagtccacgccgtaaacgatgaatgccagtcgtcgggcagcatgctgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttttccgagaggaattccttcagttcggctggatcagtgacaggtgctgcatggctgtcgtcagctcgtgtcgtgagatgttcggttaagtccggcaacgagcgcaacccacacccctagttgccaatgatggaactctaggggaactgccgatgataagtcggaggaaggtgtggatgacgtcaagtcctcatggcccttacgggttgggctacacacgtgctacaatggcagtgacaatgggttaatccccaaaagctgtctcagttcggattgtcctctgcaactcgagggcatgaagtcggaatcgctagtaatcgcgtaacagcatgacgcggtgaatacgttcccgggccttgtacacaccgcccgtcacaccatgggagttgggtttacccgaagacggtgcgccaacccttacggggggcagctggccacggtaagctcagcgactggggtgaagtcgtaacaaggtagccgtaggggaacctgcggctggatcacctcctttctaa

SEQ ID NO: 7829 - DNA, 1497 bp, Rhodovulum sp. PH10
  ref <308>: DATABASE ACCESSION NUMBER: NCBI ACCESSION: NZ_AKZI01000144.1
  ref <309>: DATABASE ENTRY DATE: 2019-04-01
  ref <313>: RELEVANT RESIDUES IN SEQ ID NO: (1)..(1497)
tccaacctgagagtttgatcctggctcagagcgaacgctggcggcaggcttaacacatgcaagtcgaacgggtgtagcaatacaccagtggcagacgggtgagtaacacgtgggaatgtgcccttcggttcggaacaacccagggaaacttgggctaataccggatacgtccgcgaggagaaagattcatcgccggaggagcagcccgcgtctgattagctagttggtgtggtaatggcgcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcggtggggaagataatgacggtacccacagaagaagccccggctaacttcgtgccagcagccgcggtaatacgaagggggctagcgttgctcggaatcactgggcgtaaagcgcacgtaggcgggtctctaagtcgggggtgaaatcccggagctcaactccggaactgccttcgatactggggacctcgagtccgggagaggtgagtggaactgcgagtgtagaggtgaaattcgtagatattcgcaagaacaccagtggcgaaggcggctcactggcccggaactgacgctgaggtgcgaaagcgtggggagcaaacaggattagataccctggtagtccacgccgtaaacgatggatgctagccgttgggcagcttgctgctcagtggcgcagctaacgccttaagcatcccgcctggggagtacggtcgcaagattaaaactcaaaggaattgacgggggcccgcacaagcggtggagcatgtggtttaattcgaagcaacgcgcagaaccttaccagctcttgacatgccacgacggttcccggagacgggttcctccccgcaaggggcgtggacacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggcggtgacagtgggacgcgaaggggtgacccttggcaaatctcaaaaaaccgtctcagttcggattgggctctgcaactcgagcccatgaagtcggaatcgctagtaatcgcagatcagcatgctgcggtgaatacgttcccgggccttgtacacaccgcccgtcacaccatgggagttggctttacctgaaggcgctgcgctaacccgcgagggaggcaggcgaccacggtagggtcagcgactggggtgaagtcgtaacaaggtagccgtaggggaacctgcggctggatcacctcctttctaagg

SEQ ID NO: 7830 - DNA, 1426 bp, Rhodovulum sulfidophilum
  ref <308>: DATABASE ACCESSION NUMBER: NCBI ACCESSION: NZ_MSYR01000001.1
  ref <309>: DATABASE ENTRY DATE: 2019-04-01
  ref <313>: RELEVANT RESIDUES IN SEQ ID NO: (1)..(1426)
caacttgagagtttgatcctggctcagaacgaacgctggcggcaggcctaacacatgcaagtcgagcgaacccttcggggttagcggcggacgggtgagtaacgcgtgggaacgtgcccttctctgcggaataggctcgggaaactgggtttaataccgcatacgcccttcgggggaaagatttatcggagaaggatcggcccgcgttagattaggtagttggtggggtaatggcctaccaagcctacgatctatagctggtttgagaggatgatcagccacactgggactgagacacggcccagactcctacgggaggcagcagtgaggaatcttggacaatgggggaaaccctgatccagccatgccgcgtgagcgatgaaggccttagggttgtaaagctctttcagtcgtgaagataatgacggtagcgacagaagaagccccggctaactccgtgccagcagccgcggtaatacggagggggctagcgttgttcggaattactgggcgtaaagcgcgcgtaggcggactattaagtcaggggtgaaatcccggggctcaaccccggaactgcctttgatactggtagtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcggcaagcatgcttgtcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctgatcgcggttttccgagaggaattccttcagttcggctggatcagtgacaggtgctgcatggctgtcgtcagctcgtgtcgtgagatgttcggttaagtccggcaacgagcgcaacccacactcttagttgccagcattcagttgggcactctaggagaactgccgatgataagtcggaggaaggtgtggatgacgtcaagtcctcatggcccttacgggttgggctacacacgtgctacaatggcagtgacaatgggttaatccctaaaaactgtctcagttcggattgttctctgcaactcgagagcatgaagtcggaatcgctagtaatcgcgtaacagcatgacgcggtgaatacgttcccgggccttgtacacaccgcccgtcacaccatgggagttgggtttacccgaagacggtgcgccaacccttacggggggcagctggccacggtaagctcagcgactggggtgaagtcgtaac

SEQ ID NO: 7831 - DNA, 1471 bp, Rhodovulum viride; identical to SEQ ID NO: 7824
  ref <308>: DATABASE ACCESSION NUMBER: NCBI ACCESSION: NZ_MUAV01000055.1
  ref <309>: DATABASE ENTRY DATE: 2019-04-01
  ref <313>: RELEVANT RESIDUES IN SEQ ID NO: (1)..(1471)

SEQ ID NO: 7832 - DNA, 1509 bp, Rickettsia aeschlimannii
  ref <308>: DATABASE ACCESSION NUMBER: NCBI ACCESSION: NZ_CCER01000003.1
  ref <309>: DATABASE ENTRY DATE: 2019-04-01
  ref <313>: RELEVANT RESIDUES IN SEQ ID NO: (1)..(1509)
gacagaatcaaacttgagagtttgatcctggctcaggacgaacgctatcggtgtgcttaacacatgcaagtcgaacgggctaattggagcttgctccaattagttagtggcagacgggtgagtaacacgtgggaacctacccatcagtacggaataacttttagaaataaaagctaataccgtatattctctacggaggaaagatttatcgctgatggatgagcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatattggaagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgcttttcttcagctcggctggaccacacacaggtgttgcatggctgtcgtcagctcgtgtcgtgagatgttgggttaagtcccgcaacgagcgcaaccctcattcttatttgccagcggataatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgcggctggattacctccttaa

SEQ ID NO: 7833 - DNA, 1512 bp, Rickettsia africae
  ref <308>: DATABASE ACCESSION NUMBER: NCBI ACCESSION: NC_012633.1
  ref <309>: DATABASE ENTRY DATE: 2019-04-01
  ref <313>: RELEVANT RESIDUES IN SEQ ID NO: (1)..(1512)
gacagaatcaaacttgagagtttgatcctggctcagaacgaacgctatcggtatgcttaacacatgcaagtcgaacgaactaatttttggggcttgctccaattagttagtggcagacgggtgagtaacacgtgggaatctacccattagtacggaataacttttagaaataaaagctaataccgtatattctctgcggaggaaagatttatcgctgatggatgagcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatatcggaagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgtggatcgcagagatgcttttcttcagctcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttagttttacctgaaggtggtgagctaacgcaagaggcagccaaccacggtaaaattagcgactggggtgaagtcgtaacaaggtagccgtaggggaacctgcggctggattacctccttaa

SEQ ID NO: 7834 - DNA, 1509 bp, Rickettsia amblyommatis
  ref <308>: DATABASE ACCESSION NUMBER: NCBI ACCESSION: NZ_CP015012.1
  ref <309>: DATABASE ENTRY DATE: 2019-04-01
  ref <313>: RELEVANT RESIDUES IN SEQ ID NO: (1)..(1509)
gacagaatcaaacttgagagtttgatcctggctcagaacgaacgctatcggtatgcttaacacatgcaagtcgaacggactaattggggcttgctccaattagttagtggcagacgggtgagtaacacgtgggaatctacccatcagtacggaataacttttagaaataaaagctaataccgtatattctctacggaggaaagatttatcgctgatggatgagcccgcgtcagattaggtagttggtgaggtaatggctcaccaagccgacgatctgtagctggtttgagaggatgatcagccacactgggactgagacacggcccagactcctacgggaggcagcagtggggaatattggacaatgggcgaaagcctgatccagcaataccgagtgagtgatgaaggccttagggttgtaaaactcttttagcaaggaagataatgacgttacttgcagaaaaagccccggctaactccgtgccagcagccgcggtaagacggggggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctaatgcacgaaagcgtggggagcaaacaggattagataccctggtagtccacgccgtaaacgatgagtgctagatatcggaagattatctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgcttttcttcagcttggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgcggctggattacctccttaa

SEQ ID NO: 7835 - DNA, 1509 bp, Rickettsia argasii
  ref <308>: DATABASE ACCESSION NUMBER: NCBI ACCESSION: NZ_LAOQ01000002.1
  ref <309>: DATABASE ENTRY DATE: 2019-04-01
  ref <313>: RELEVANT RESIDUES IN SEQ ID NO: (1)..(1509)
gacagaatcaaacttgagagtttgatcctggctcagaacgaacgctatcggtatgcttaacacatgcaagtcgaacggactaattggggcttgctccaattagttagtggcagacgggtgagtaacacgtgggaatctacccatcagtacggaataacttttagaaataaaagctaataccgtatattctctgcggaggaaagatttattgctgatggatgagcccgcgtcagattaggtagttggtgaggtaatggctcaccaagctgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcgatcatctgggctacaactgacgctgatgcacgaaagcgtggggagcaaacaggattagataccctggtagtccacgccgtaaacgatgagtgctagatatcggaagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgcttttcttcagctcggctggatcacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgcggctggattacctccttaa

SEQ ID NO: 7836 - DNA, 1510 bp, Rickettsia australis
  ref <308>: DATABASE ACCESSION NUMBER: NCBI ACCESSION: NC_017058.1
  ref <309>: DATABASE ENTRY DATE: 2019-04-01
  ref <313>: RELEVANT RESIDUES IN SEQ ID NO: (1)..(1510)
gacagaatcaaacttgagagtttgatcctggctcagaacgaacgctatcggtatgcttaacacatgcaagtcggacggactaattgggggtttactctaattagttagtggcagacgggtgagtaacacgtgggaatctgcccatcagtacggaataacttttagaaataaaagctaataccgtatattctctacggaggaaagatttatcgctgatggatgagcccgcgtcagattaggtagttggtgaggtaacggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccctagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatatcggaagattttctttcggtttcgcagctaacgcattaagcactccgcctggggagtacggtcgcaagattaaaactcaaaggaattgacgggggctcgcacaagcggtggagcatgcggtttaattcgatgttacgcgaagaaccttaccaacccttgacatggtggttgcggatcgcagagatgctttccttcagctcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgcggctggattacctccttaa

SEQ ID NO: 7837 - DNA, 1510 bp, Rickettsia bellii
  ref <308>: DATABASE ACCESSION NUMBER: NCBI ACCESSION: NZ_CP015010.1
  ref <309>: DATABASE ENTRY DATE: 2019-04-01
  ref <313>: RELEVANT RESIDUES IN SEQ ID NO: (1)..(1510)
gacagaatcaaacttgagagtttgatcctggctcagaacgaacgctatcggtatgcttaacacatgcaagtcgaacggactaatttggggcttgctccaattagttagtggcagacgggtgagtaacacgtgggaatctgcccatcagtacggaataacttttagaaataaaagctaataccgtatattctctacggaggaaagatttatcgctgatggatgagcctgcgtcagattaggtagttggtgaggtaatggctcaccaagcctacgatctgtagctggtctgagaggatgatcagccacactgggactgagacacggcccagactcctacgggaggcagcagtggggaatattggacaatgggcgaaagcctgatccagcaataccgagtgagtgatgaaggccctagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatattgggagattttttctcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggttgcggatcgcagagatgctttccttcagttcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgggctaacgcaagaggcagccaaccacggtaaaattagcgactggggtgaagtcgtaacaaggtagccgtaggggaacctgcggctggattacctccttaa

SEQ ID NO: 7838 - DNA, 1509 bp, Rickettsia buchneri
  ref <308>: DATABASE ACCESSION NUMBER: NCBI ACCESSION: NZ_JFKF01000109.1
  ref <309>: DATABASE ENTRY DATE: 2019-04-01
  ref <313>: RELEVANT RESIDUES IN SEQ ID NO: (1)..(1509)
gacagaatcaaacttgagagtttgatcctggctcagaacgaacgctatcggtatgcttaacacatgcaagtcgaacggactaattggggcttgctccaattagttagtggcagacgggtgagtaacacgtgggaatctacccatcagtacggaataacttttagaaataaaagctaataccgtatattctctacggaagaaagatttatcgctgatggatgagcccgcgtcagattaggtcgttggtgaggtaacggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctaatgcacgaaagcgtggggagcaaacaggattagataccctggtagtccacgccgtaaacgatgagtgctagatatcggaagattctctttcggtttcgcagctaacgcattaagcactccgcctggagagtacggtcgcaagattaaaactcaaaggaattgacgggggctcgcacaagcggtggagcatgcggtttaattcgatgttacgcgaaaaaccttaccaacccttgacatggtggtcgcggattgcagagatacttttcttcagctcggctggaccacacacaggtgttgcacggctgtcgtcagctcgtgtcgtgagatgttgggttaagtcccgcaacgagcgcaaccctcattcttatttgccagcgggtaatgccgggaactataagaaaactgctggtgataagccagaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgtggctggattacctccttaa

SEQ ID NO: 7839 - DNA, 1509 bp, Rickettsia canadensis
  ref <308>: DATABASE ACCESSION NUMBER: NCBI ACCESSION: NC_016929.1
  ref <309>: DATABASE ENTRY DATE: 2019-04-01
  ref <313>: RELEVANT RESIDUES IN SEQ ID NO: (1)..(1509)
gacagaattaaacttgagagtttgatcctggctcagaacgaacgctatcggtatgcttaacacatgcaagtcgaacggactaattagggcttgctctaattagttagtggcagacgggtgagtaacacgtgggaatctgcccatcagtacggaataacttttagaaataaaagctaataccgtatattctctacagaggaaagatatatcgctgatggatgagcccgcgtcagattaggtagttggtgaggtaatggctcaccaagccaacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcgatcatctaggctataactgacgctgatgcacgaaagcgtggggagcaaacaggattagataccctggtagtccacgccgtaaacgatgagtgctagatatcgggagaatatctctcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggattgcagagatgctttccttcagttcggctggaccacacacaggtgttgcatggctgtcgtcagctcgtgtcgtgagatgttgggttaagtcccgcaacgagcgcaaccctcattcttatttgccagcggataatgccgggaactataagaaaactgccagtgataagctggaggaaggtggggacgacgtcaagtcatcatggcccttacgggttgggctacacgcgtgctacaatggtgtttacagagggaagcaaaacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgcggctggattacctccttaa

SEQ ID NO: 7840 - DNA, 1500 bp, Rickettsia conorii
  ref <308>: DATABASE ACCESSION NUMBER: NCBI ACCESSION: NZ_AJUR01000016.1
  ref <309>: DATABASE ENTRY DATE: 2019-04-01
  ref <313>: RELEVANT RESIDUES IN SEQ ID NO: (1)..(1500)
aaacttgagagtttgatcctggctcagaacgaacgctatcggtatgcttaacacatgcaagtcgaacggactaattggggcttgctccagttagttagtggcagacgggtgagtaacacgtgggaatctacccattagtacggaataacttttagaaataaaagctaataccgtatattctctgcggaggaaagatttatcgctgatggatgagcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatatcggaagagtctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgcttttcttcagctcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttagttttacctgaaggtggtgagctaacgcaagaggcagccaaccacggtaaaattagcgactggggtgaagtcgtaacaaggtagccgtaggggaacctgcggctggattacctccttaa

SEQ ID NO: 7841 - DNA, 1509 bp, Rickettsia endosymbiont of Ixodes pacificus
  ref <308>: DATABASE ACCESSION NUMBER: NCBI ACCESSION: NZ_LAOP01000001.1
  ref <309>: DATABASE ENTRY DATE: 2019-04-01
  ref <313>: RELEVANT RESIDUES IN SEQ ID NO: (1)..(1509)
gacagaatcaaacttgagagtttgatcctggctcagaacgaacgctatcggtatgcttaacacatgcaagtcgaacggactaattggggcttgctccaattagttagtggcagacgggtgagtaacacgtgggaatctacccatcagtacggaataacttttagaaataaaagctaataccgtatattctctacggaagaaagatttatcgctgatggatgagcccgcgtcagattaggtagttggtgaggtaacggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctaatgcacgaaagcgtggggagcaaacaggattagataccctggtagtccacgccgtaaacgatgagtgctagatatcggaagattctctttcggtttcgcagctaacgcattaagcactccgcctggagagtacggtcgcaagattaaaactcaaaggaattgacgggggctcgcacaagcggtggagcatgcggtttaattcgatgttacgcgaaaaaccttaccaacccttgacatggtggtcgcggatcgcagagatgctttccttcagctcggctggaccacacacaggtgttgcacggctgtcgtcagctcgtgtcgtgagatgttgggttaagtcccgcaacgagcgcaaccctcattcttatttgccagcgggtaatgccgggaactataagaaaactgctggtgataagccagaggaaggtggggacgacgtcaagtcatcatggcccttacgggttgggctacacgcgtgctacaatggtgtttacagagggaagcaagacggcgacgtggagcaaatctctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgcggctggattacctccttaa

SEQ ID NO: 7842 - DNA, 1509 bp, Rickettsia endosymbiont of Ixodes scapularis; identical to SEQ ID NO: 7838
  ref <308>: DATABASE ACCESSION NUMBER: NCBI ACCESSION: NZ_CM000770.1
  ref <309>: DATABASE ENTRY DATE: 2019-04-01
  ref <313>: RELEVANT RESIDUES IN SEQ ID NO: (1)..(1509)

SEQ ID NO: 7843 - DNA, 1509 bp, Rickettsia felis
  ref <308>: DATABASE ACCESSION NUMBER: NCBI ACCESSION: NZ_LANQ01000001.1
  ref <309>: DATABASE ENTRY DATE: 2019-04-01
  ref <313>: RELEVANT RESIDUES IN SEQ ID NO: (1)..(1509)
gacagaatcaaacttgagagtttgatcctggctcagaacgaacgctatcggtatgcttaacacatgcaagtcggacggactaattggggcttgctccaattagttagtggcagacgggtgagtaacacgtgggaatctgcccatcagtacggaataacttttagaaataaaagctaataccgtatattctctacagaggaaagatttatcgctgatggatgagcccgcgtcagattaggtagttggtgaggtaacggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccctagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatatcggaagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgctttccttcagctcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgcggctggattacctccttaa

SEQ ID NO: 7844 - DNA, 1502 bp, Rickettsia fournieri
  ref <308>: DATABASE ACCESSION NUMBER: NCBI ACCESSION: NZ_LT978484.1
  ref <309>: DATABASE ENTRY DATE: 2019-04-01
  ref <313>: RELEVANT RESIDUES IN SEQ ID NO: (1)..(1502)
tcaaacttgagagtttgatcctggctcagaacgaacgctatcggtatgcttaacacatgcaagtcgaacggactaattggggcttgctccaattagttagtggcagacgggtgagtaacacgtgggaatctccccatcagtacggaataacttttagaaataaaagctaataccgtatattctctgcggaggaaagatttatcgctgatggatgagcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaagaacaccggtggcgaaggcgatcatctgggctacaactgacgctgatgcacgaaagcgtggggagcaaacaggattagataccctggtagtccacgccgtaaacgatgagtgctagatatcggaagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgcttttcttcagctcggctggatcacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgcggctggattacctccttaa

SEQ ID NO: 7845 - DNA, 1509 bp, Rickettsia heilongjiangensis
  ref <308>: DATABASE ACCESSION NUMBER: NCBI ACCESSION: NC_015866.1
  ref <309>: DATABASE ENTRY DATE: 2019-04-01
  ref <313>: RELEVANT RESIDUES IN SEQ ID NO: (1)..(1509)
gacagaatcaaacttgagagtttgatcctggctcagaacgaacgctatcggtatgcttaacacatgcaagtcgaacggactaattggggcttgctccaattagttagtggcagacgggtgagtaacacgtgggaatctacccatcagtacggaataacttttagaaataaaagctaataccgtatattctctgcggaggaaagatttattgctgatggatgagcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcgatcatctgggctacaactgacgctgatgcacgaaagcgtggggagcaaacaggattagataccctggtagtccacgccgtaaacgatgagtgctagatatcggaagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgcttttcttcagctcggctggatcacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggtgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgcggctggattacctccttaa

SEQ ID NO: 7846 - DNA, 1509 bp, Rickettsia helvetica
  ref <308>: DATABASE ACCESSION NUMBER: NCBI ACCESSION: NZ_CM001467.1
  ref <309>: DATABASE ENTRY DATE: 2019-04-01
  ref <313>: RELEVANT RESIDUES IN SEQ ID NO: (1)..(1509)
gacagaatcaaacttgagagtttgatcctggctcagaacaaacgctatcggtatgcttaacacatgcaagtcgaacggactaattggggcttgttccagttagttagtggcagacgggtgagtaacacgtgggaatctacccatcagtatggaataacttttagaaataaaagctaataccatatattctctatggaggaaagatttatcgctgatggatgagcccgcgtcagattaggtagttggtgaggtaacggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcgatcatctgggctacaactgacgctgatgcacgaaagcgtggggagcaaacaggattagataccctggtagtccacgccgtaaacgatgagtgctagatatcggaagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgctttccttcagctcggctggaccacacacaggtgttgcatggctgtcgtcagctcgtgtcgtgagatgttgggttaagtcccgcaacgagcgcaaccctcattcttatttgccagcgggtaatgccaggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgcggctggattacctccttaa

SEQ ID NO: 7847 - DNA, 1509 bp, Rickettsia honei
  ref <308>: DATABASE ACCESSION NUMBER: NCBI ACCESSION: NZ_AJTT01000005.1
  ref <309>: DATABASE ENTRY DATE: 2019-04-01
  ref <313>: RELEVANT RESIDUES IN SEQ ID NO: (1)..(1509)
gacagaatcaaacttgagagtttgatcctggctcagaacgaacgctatcggtatgcttaacacatgcaagtcgaacggattaattggggcttgctccaattagttagtggcagacgggtgagtaacacgtgggaatctacccatcagtacggaataacttttagaaataaaagctaataccgtatattctctgcggaggaaagatttatcgctgatggatgagcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactagtctagagtgtagtaggggatgatggaattcctagtgtagaggtgaaattcttagatattaggaggaacaccagtggcgaaggcggtcatctgggctacaactgacgctgatgcacgaaagcgtggggagcaaacaggattagataccctggtagtccacgccgtaaacgatgagtgctagatatcggaagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgcttttcttcagctcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttagttttacctgaaggtggtgagctaacgcaagaggcagccaaccacggtaaaattagcgactggggtgaagtcgtaacaaggtagccgtaggggaacctgcggctggattacctccttaa

SEQ ID NO: 7848 - DNA, 1509 bp, Rickettsia hoogstraalii
  ref <308>: DATABASE ACCESSION NUMBER: NCBI ACCESSION: NZ_CCXM01000001.1
  ref <309>: DATABASE ENTRY DATE: 2019-04-01
  ref <313>: RELEVANT RESIDUES IN SEQ ID NO: (1)..(1509)
gacagaatcaaacttgagagtttgatcctggctcagaacgaacgctatcggtatgcttaacacatgcaagtcggacggactaattggggcttgctccaattagttagtggcagacgggtgagtaacacgtgggaatctgcctatcagtacggaataacttttagaaataaaagctaataccgtatattctctacggaggaaagatttatcgctgatagatgagcccgcgtcagattaggtagttggtgaggtaacggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccgaggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatatcggaagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgctttccttcagctcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacaggttgggctacacgcgtgctacaatggtgtttacagaaggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgcggctggattacctccttaa

SEQ ID NO: 7849 - DNA, 1502 bp, Rickettsia japonica
  ref <308>: DATABASE ACCESSION NUMBER: NCBI ACCESSION: NZ_AP017572.1
  ref <309>: DATABASE ENTRY DATE: 2019-04-01
  ref <313>: RELEVANT RESIDUES IN SEQ ID NO: (1)..(1502)
tcaaacttgagagtttgatcctggctcagaacgaacgctatcggtatgcttaacacatgcaagtcgaacggactaattggggcttgctccaattagttagtggcagacgggtgagtaacacgtgggaatctacccatcagtacggaataacttttagaaataaaagctaataccgtatattctctgcggaggaaagatttattgctgatggatgagcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcgatcatctgggctacaactgacgctgatgcacgaaagcgtggggagcaaacaggattagataccctggtagtccacgccgtaaacgatgagtgctagatatcggaagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgcttttcttcagctcggctggatcacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgcggctggattacctccttaa

SEQ ID NO: 7850 - DNA, 1509 bp, Rickettsia massiliae
  ref <308>: DATABASE ACCESSION NUMBER: NCBI ACCESSION: NC_016931.1
  ref <309>: DATABASE ENTRY DATE: 2019-04-01
  ref <313>: RELEVANT RESIDUES IN SEQ ID NO: (1)..(1509)
gacagaatcaaacttgagagtttgatcctggctcagaacgaacgctatcggtatgcttaacacatgcaagtcgaacggactaattggggcttgctccaattagttagtggcagacgggtgagtaacacgtgggaatctacccatcagtacggaataacttttagaaataaaagctaataccgtatattctctacggaggaaagatttatcgctgatggatgagcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatatcggaagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggattgcagagatgcttttcttcagctcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggatgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgcggctggattacctccttaa

SEQ ID NO: 7851 - DNA, 1509 bp, Rickettsia montanensis
  ref <308>: DATABASE ACCESSION NUMBER: NCBI ACCESSION: NC_017043.1
  ref <309>: DATABASE ENTRY DATE: 2019-04-01
  ref <313>: RELEVANT RESIDUES IN SEQ ID NO: (1)..(1509)
gacagaattaaacttgagagtttgatcctggctcagaacgaacgctatcggtatgcttaacacatgcaagtcgaacggactaattggagcttgctccaattagttagtggcagacgggtgagtaacgcgtgggaatctacccatcagtacggaataacttttagaaataaaagctaataccgtatattctctacggaggaaaggtttatcgctgatggatgagcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcagggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctgcaactgacgctgatgcacgaaagcgtggggagcaaacaggattagataccctggtagtccacgccgtaaacgatgagtgctagatatcggaagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgtgaatcgcagagatgcttttcttcagctcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgcggctggattacctccttaa

SEQ ID NO: 7852 - DNA, 1510 bp, Rickettsia parkeri
  ref <308>: DATABASE ACCESSION NUMBER: NCBI ACCESSION: NZ_LAOO01000001.1
  ref <309>: DATABASE ENTRY DATE: 2019-04-01
  ref <313>: RELEVANT RESIDUES IN SEQ ID NO: (1)..(1510)
gacagaatcaaacttgagagtttgatcctggctcagaacgaacgctatcggtatgcttaacacatgcaagtcgaacggactaatttggggcttgctccaattagttagtggcagacgggtgagtaacacgtgggaatctacccattagtacggaataacttttagaaataaaagctaataccgtatattctctgcggaggaaagatttatcgctgatggatgagcccgcgtcagattaggtagttggtgaggtaatagctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcgtctgggctacaactgacgctgatgcacgaaagcgtggggagcaaacaggattagataccctggtagtccacgccgtaaacgatgagtgctagatatcggaagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgcttttcttcagctcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttagttttacctgaaggtggtgagctaacgcaagaggcagccaaccacggtaaaattagcgactggggtgaagtcgtaacaaggtagccgtaggggaacctgcggctggattacctccttaa

SEQ ID NO: 7853 - DNA, 1509 bp, Rickettsia peacockii
  ref <308>: DATABASE ACCESSION NUMBER: NCBI ACCESSION: NC_012730.1
  ref <309>: DATABASE ENTRY DATE: 2019-04-01
  ref <313>: RELEVANT RESIDUES IN SEQ ID NO: (1)..(1509)
gacagaatcaaacttgagagtttgatcctggctcagaacgaacgctatcggtatgcttaacacatgcaagtcgaacggactaattggggcttgctccaattagttagtggcagacgggtgagtaacacgtgggaatctacccatcagtacggaataacttttagaaataaaagctaataccgtatattctctgcggaggaaagatttatcgctgatggatgagcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatatcggaagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggttgcggatcgcagagatgcttttcttcagctcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagatatctcagttcggattgttctctgcaactcgagagcatgaagttggaatcgctagtaatcgcggatcagcatgccgcggtgaatacgttctcgggccttgtacacactgcccgtcacgccatgggagttagttttacctgaaggtggtgagctaacgcaagaggcagccaaccacggtaaaattagcgactggggtgaagtcgtaacaaggtagccgtaggggaacctgcggctggattacctccttaa

SEQ ID NO: 7854 - DNA, 1509 bp, Rickettsia philipii
  ref <308>: DATABASE ACCESSION NUMBER: NCBI ACCESSION: NC_016930.1
  ref <309>: DATABASE ENTRY DATE: 2019-04-01
  ref <313>: RELEVANT RESIDUES IN SEQ ID NO: (1)..(1509)
gacagaatcaaacttgagagtttgatcctggctcagaacgaacgctatcggtatgcttaacacatgcaagtcgaacggactaattggggcttgctccaattagttagtggcagacgggtgagtaacacgtgggaatctacccatcagtacggaataacttttagaaataaaagctaataccgtatattctctgcggaggaaagatttatcgctgatggatgagcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctaccactgacgctgatgcacgaaagcgtggggagcaaacaggattagataccctggtagtccacgccgtaaacgatgagtgctagatatcgggagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggttgcggatcgcagagatgcttttcttcagctcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttagttttacctgaaggtggtgagctaacgcaagaggcagccaaccacggtaaaattagcgactggggtgaagtcgtaacaaggtagccgtaggggaacctgcggctggattacctccttaa

SEQ ID NO: 7855 - DNA, 1509 bp, Rickettsia prowazekii
  ref <308>: DATABASE ACCESSION NUMBER: NCBI ACCESSION: NZ_CP014865.1
  ref <309>: DATABASE ENTRY DATE: 2019-04-01
  ref <313>: RELEVANT RESIDUES IN SEQ ID NO: (1)..(1509)
gacagaatcaaacttgagagtttgatcctggctcagaacgaacgctatcggtatgcttaacacatgcaagtcgaacggattaactagagctcgctttagttaattagtggcagacgggtgagtaacacgtgggaatctacccatcagtacggaataacttttagaaataaaagctaataccgtatattctctacggaggaaagatttatcgctgatggatgggcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatatcggaggattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggttacggattgcagagatgctttccttcagttcggctgggccacacacaggtgttgcatggctgtcgtcagctcgtgtcgtgagatgttgggttaagtcccgcaacgagcgcaacccttattcttatttgccagtgggtaatgccgggaactataagaaaactgccggtgataagccggaggaaggtggggacgacgtcaagtcatcatggcccttacgggttgggctacacgcgtgctacaatggtgtttacagagggaagcaatacggtgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgcggctggattacctccttaa

SEQ ID NO: 7856 - DNA, 1500 bp, Rickettsia raoultii
  ref <308>: DATABASE ACCESSION NUMBER: NCBI ACCESSION: NZ_CP019435.1
  ref <309>: DATABASE ENTRY DATE: 2019-04-01
  ref <313>: RELEVANT RESIDUES IN SEQ ID NO: (1)..(1500)
gacagaatcaaacttgagagtttgatcctggctcagaacgaacgctatcggtatgcttaacacatgcaagtcgaacggactaattggggcttgctccaattagttagtggcagacgggtgagtaacacgtgggaatctacccatcagtacggaataacttttagaaataaaagctaataccgcatattctctacggaggaaagatttatcgctgatggatgagcccgcgtcagattagttagtaggtgaggtaatggctcacctaggcgatgatacgtagccgaactgagaggttgatcggccacattgggactgagatacggcccagactcctacgggaggcagcagtagggaatttttcacaatggacgaaagtctgatgaagcaatgccgcgtgagtgatgacggccttcgggttgtaaagctctgttgtaagggaagaaaatgacgttacttgcagaaaaagccacggctaactatgtgccagcagccgcggtaatacataggtggcaagcgttatccggatttattgggcgtatagggtgcgtaggcggttttgcaagtttgaggttaaagcccggagctcaactccggtctcgccttgaaaactgcattactagaatgcaagagaggtaagctggaattccatgtgtagcggtgaaatgcgtagatatatggaagaacacctgtggcgaaagcggcttactggcttgttattgacgctgaggcacgaaagcgtggggagcaaataggattagataccctggtagtccacgccgtaaacgatgagtactaggtgttggggttatctcagcgccgcagctaacgcattaagtactccgcctgagtagtatgctcgcaagagtgaaactcaaaggaattgacggggacccgcacaagtggtggagcatgtggtttaattcgaagcaacacgaagaaccttaccagggcttgacatccagtgcaaagctatagagatatagtggaggttaacattgagacaggtggtgcatggttgtcgtcagttcgtgccgtgaggtgttgggttaagtcccgcaacgaacgcaacccttgtcgttagttactaacattaagttgaggactctaacgagactgctagtgtaagctagaggaaggtggggatgacgtcaaatcatcatgccccttatgtcctgggctacacacgtgctacaatggctggtacaaagagtcgcaatctcgtgagggggagctaatctcaaaaagccagtctcagttcggattgaagtctgcaactcgacttcatgaagccggaatcactagtaatcgcgaatcagctatgtcgcggtgaatacgttctcgggtcttgtacacaccgcccgtcacaccacgagagttggtaataccagaagtgggtagcttaaccgcaaggagagcagcctcccaaggtaggactggcgattggggtgaagtcgtaacaaggtatccgtacgggaacgtgcggatggatcacctccttaa

SEQ ID NO: 7857 - DNA, 1509 bp, Rickettsia rhipicephali
  ref <308>: DATABASE ACCESSION NUMBER: NCBI ACCESSION: NZ_CP013133.1
  ref <309>: DATABASE ENTRY DATE: 2019-04-01
  ref <313>: RELEVANT RESIDUES IN SEQ ID NO: (1)..(1509)
gacagaatcaaacttgagagtttgatcctggctcagaacgaacgctatcggtatgcttaacacatgcaagtcgaacgggctaattggggcttgctccaattagttagtggcagacgggtgagtaacacgtgggaatctacccatcagtacggaataacttttagaaataaaagctaataccgtatattctctacggaggaaagatttatcgctgatggatgagcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtatagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatatcggaagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgcttttcttcagctcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtaagctaacgcaagaggcagccaaccacggtaaaattagcgactggggtgaagtcgtaacaaggtagccgtaggggaacctgcggctggattacctccttaa

SEQ ID NO: 7858 - DNA, 1509 bp, Rickettsia rickettsii
  ref <308>: DATABASE ACCESSION NUMBER: NCBI ACCESSION: NZ_CP018914.1
  ref <309>: DATABASE ENTRY DATE: 2019-04-01
  ref <313>: RELEVANT RESIDUES IN SEQ ID NO: (1)..(1509)
gacagaatcaaacttgagagtttgatcctggctcagaacgaacgctatcggtatgcttaacacatgcaagtcgaacggactaattggggcttgctccaattagttagtggcagacgggtgagtaacacgtgggaatctacccatcagtacggaataacttttagaaataaaagctaataccgtatattctctgcggaggaaagatttatcgctgatggatgagcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctaccactgacgctgatgcacgaaagcgtggggagcaaacaggattagataccctggtagtccacgccgtaaacgatgagtgctagatatcggaagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggttgcggatcgcagagatgcttttcttcagctcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttagttttacctgaaggtggtgagctaacgcaagaggcagccaaccacggtaaaattagcgactggggtgaagtcgtaacaaggtagccgtaggggaacctgcggctggattacctccttaa

SEQ ID NO: 7859 - DNA, 1502 bp, Rickettsia sibirica
  ref <308>: DATABASE ACCESSION NUMBER: NCBI ACCESSION: NZ_AHZB01000018.1
  ref <309>: DATABASE ENTRY DATE: 2019-04-01
  ref <313>: RELEVANT RESIDUES IN SEQ ID NO: (1)..(1502)
aaacttgagagtttgatcctggctcagaacgaacgctatcggtatgcttaacacatgcaagtcgaacggactaatttggggcttgctccaatttagttagtggcagacgggtgagtaacacgtgggaatctacccattagtacggaataacttttagaaataaaagctaataccgtatattctctgcggaggaaagatttatcgctgatggatgagcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttgggagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatatcggaagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgcttttcttcagctcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttagttttacctgaaggtggtgagctaacgcaagaggcagccaaccacggtaaaattagcgactggggtgaagtcgtaacaaggtagccgtaggggaacctgcggctggattacctccttaa

SEQ ID NO: 7860 - DNA, 1509 bp, Rickettsia slovaca
  ref <308>: DATABASE ACCESSION NUMBER: NCBI ACCESSION: NC_017065.1
  ref <309>: DATABASE ENTRY DATE: 2019-04-01
  ref <313>: RELEVANT RESIDUES IN SEQ ID NO: (1)..(1509)
gacagaatcaaacttgagagtttgatcctggctcagaacgaacgctatcggtatgcttaacacatgcaagtcgaacggactaattggggcttgctccaattagttagtggcagacgggtgagtaacacgtgggaatctacccatcagtacggaataacttttagaaataaaagctaataccgtatattctctgcggaggaaagatttatcgctgatggatgagcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatatcggaagattctctttcggtttcgtagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgcttttcttcagctcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttagttttacctgaaggtggtgagctaacgcaagaggcagccaaccacggtaaaattagcgactggggtgaagtcgtaacaaggtagccgtaggggaacctgcggctggattacctccttaa

SEQ ID NO: 7861 - DNA, 1509 bp, Rickettsia sp. Tenjiku01
  ref <308>: DATABASE ACCESSION NUMBER: NCBI ACCESSION: NZ_BCMR01000024.1
  ref <309>: DATABASE ENTRY DATE: 2019-04-01
  ref <313>: RELEVANT RESIDUES IN SEQ ID NO: (1)..(1509)
gacagaatcaaacttgagagtttgatcctggctcagaacgaacgctatcggtatgcttaacacatgcaagtcgaacggactaattggggcttgctccaattagttagtggcagacgggtgagtaacacgtgggaatctacccatcagtacggaataacttttagaaataaaagctaataccgtatattctctgcggaggaaagatttatcgctgatggatgagcccgcgtcagattaggtagttggtgaggtaatggctcaccaagccgacgatctgtagctggtctgagaggatgatcagccacactgggactgagacacggcccagactcctacgggaggcagcagtggggaatattggacaatgggcgaaggcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatatcggaaggttccctttcggtttcgtagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgcttttcttcagctcggctggaccacacacaggtgttgcatggctgtcgtcagctcgtgtcgtgagatgttgggttaagtcccgcaacgagcgcaaccctcattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggtgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttagttttacctgaaggtggtgagctaacgcaagaggcagccaaccacggtaaaattagcgactggggtgaagtcgtaacaaggtagccgtaggggaacctgcggctggattacctccttaa

SEQ ID NO: 7862 - DNA, 1509 bp, Rickettsia sp. wb
  ref <308>: DATABASE ACCESSION NUMBER: NCBI ACCESSION: NZ_LYMV01000007.1
  ref <309>: DATABASE ENTRY DATE: 2019-04-01
  ref <313>: RELEVANT RESIDUES IN SEQ ID NO: (1)..(1509)
gacagaatcaaacttgagagtttgatcctggctcagaacgaacgctatcggtatgcttaacacatgcaagtcgaacggactaattggggcttgctccaattagttagtggcagacgggtgagtaacacgtgggaatctgcccatcagtacggaataacttttagaaataaaagctaataccgtatattctctacggaggaaagatttatcgctgatggatgagcccgcgtcagattaggtagttggtgaggtaatggcttaccaagcctacgatctgtagctggtctgagaggatgatcagccacactgggactgagacacggcccagactcctacgggaggcagcagtggggaatattggacaatgggcgaaagcctgatccagcaataccgagtgagtgatgaaggccctagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcctggggcttaacctcggaattgctttcaaaactactaatctagagtgtagtaggggatgatggaattcctagtgtagaggtgaaattcttagatattaggaggaacaccagtggcgaaggcggtcatctgggctacaactgacgctgatgcacgaaagcgtggggagcaaacaggattagataccctggtagtccacgccgtaaacgatgagtgctagatattgggatattttctctcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgctttccttcagttcggctggaccacacacaggtgttgcatggctgtcgtcagctcgtgtcgtgagatgttgggttaagtcccgcaacgagcgcaaccctcattcttatttgccagcgggtaatgccaggaactataagaaaactgccagtgataagctggaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgcggctggattacctccttaa

SEQ ID NO: 7863 - DNA, 741 bp, Rickettsia sp. wq
  ref <308>: DATABASE ACCESSION NUMBER: NCBI ACCESSION: NZ_LYMW01000120.1
  ref <309>: DATABASE ENTRY DATE: 2019-04-01
  ref <313>: RELEVANT RESIDUES IN SEQ ID NO: (1)..(741)
tcctacgggaggcagcagtggggaatattggacaatgggcgaaagcctgatccagcaataccgagtgagtgatgaaggccctagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcctggggcttaacctcggaattgctttcaaaactactaatctagagtgtagtaggggatgatggaattcctagtgtagaggtgaaattcttagatattaggaggaacaccagtggcgaaggcggtcatctgggctacaactgacgctgatgcacgaaagcgtggggagcaaacaggattagataccctggtagtccacgccgtaaacgatgagtgctagatattgggatattttctctcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgctttccttcagttcggctggaccacacacaggtgttgcatggctgtcgtcagctcgtgtcgtgagatgttgggttaagtcccgcaac

SEQ ID NO: 7864 - DNA, 1509 bp, Rickettsia tamurae
  ref <308>: DATABASE ACCESSION NUMBER: NCBI ACCESSION: NZ_CCMG01000008.1
  ref <309>: DATABASE ENTRY DATE: 2019-04-01
  ref <313>: RELEVANT RESIDUES IN SEQ ID NO: (1)..(1509)
gacagaatcaaacttgagagtttgatcctggctcagaacgaacgctatcggtatgcttaacacatgcaagtcaaacggaccaattggggcttgctccaattagttagtggcagacgggtgagtaacgcgtgggaatctacccatcagtacggaataacttttagaaataaaagctaataccgtatattctctacggaggaaagatttatcgctgatggatgagcccgcgtcagattaggtagttggtgaggtaacggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggcggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatatcggaagattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggtcgcggatcgcagagatgctttccttcagctcggctggaccacacacaggtgttgcacggctgtcgtcagctcgtgtcgtgagatgttgggttaagtcccgcaacgagcgcaaccctcattcttatttgccagcgggtaatgccgggaactataagaaaactgctggtgataagccagaggaaggtggggacgacgtcaagtcatcatggcccttacgggttgggctacacgcgtgctacaatggtgtttacagagggaagcaagacggcgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgcggctggattacctccttaa

SEQ ID NO: 7865 - DNA, 1500 bp, Rickettsia typhi
  ref <308>: DATABASE ACCESSION NUMBER: NCBI ACCESSION: NZ_LS992663.1
  ref <309>: DATABASE ENTRY DATE: 2019-04-01
  ref <313>: RELEVANT RESIDUES IN SEQ ID NO: (1)..(1500)
aaacttgagagtttgatcctggctcagaacgaacgctatcggtatgcttaacacatgcaagtcgaacggattaattagagcttgctctagttaattagtggcagacgggtgagtaacacgtgggaatctacccatcagtacggaataacttttagaaataaaagctaataccgtatattctctacggaggaaagatttatcgctgatggatgggcccgcgtcagattaggtagttggtgtggtaatggctcaccaagccgacgatctgtagctggtctgagaggatgatcagccacactgggactgagacacggcccagactcctacgggaggcagcagtggggaatattggacaatgggcgaaagcctgatccagcaataccgagtgagtgatgaaggccttagggttgtaaagctcttttagcaaggaagataatgacgttacttgcagaaaaagccccggctaactccgtgccagcagccgcggtaagacggagggggctagcgttgttcggaattactgggcgtaaagagtgcgtaggtggtttagtaagttggaagtgaaagcccggggcttaacctcggaattgctttcaaaactactaatctagagtgtagtaggggatgatggaattcctagtgtagaggtgaaattcttagatattaggaggaacaccggtggcgaaggcggtcatctgggctacaactgacgctgatgcacgaaagcgtggggagcaaacaggattagataccctggtagtccacgccgtaaacgatgagtgctagatatcggaggattctctttcggtttcgcagctaacgcattaagcactccgcctggggagtacggtcgcaagattaaaactcaaaggaattgacgggggctcgcacaagcggtggagcatgcggtttaattcgatgttacgcgaaaaaccttaccaacccttgacatggtggttatggattgcagagatgctttccttcagttcggctgggccacacacaggtgttgcatggctgtcgtcagctcgtgtcgtgagatgttgggttaagtcccgcaacgagcgcaacccttattcttatttgccagcgggtaatgccgggaactataagaaaactgccggtgataagccggaggaaggtggggacgacgtcaagtcatcatggcccttacgggttgggctacacgcgtgctacaatggtgtttacagagggaagcaagacggtgacgtggagcaaatccctaaaagacatctcagttcggattgttctctgcaactcgagagcatgaagttggaatcgctagtaatcgcggatcagcatgccgcggtgaatacgttctcgggccttgtacacactgcccgtcacgccatgggagttggttttacctgaaggtggtgagctaacgcaagaggcagccaaccacggtaaaattagcgactggggtgaagtcgtaacaaggtagccgtaggggaacctgcggctggattacctccttaa

SEQ ID NO: 7866 - DNA, 1560 bp, Rickettsiales bacterium Ac37b
  ref <308>: DATABASE ACCESSION NUMBER: NCBI ACCESSION: NZ_CP009217.1
  ref <309>: DATABASE ENTRY DATE: 2019-04-01
  ref <313>: RELEVANT RESIDUES IN SEQ ID NO: (1)..(1560)
atcataacttgagagtttgatcctggctcagaacgaacgctggcggcacgcttaacacatgcaagtcgaacggattttataactagcttgctagttataaaattagtggcaaacgggtgagtaacacgtgggaatctacccagtaatacggaataacagctggaaacagctgctaataccgtatattctccttggaggaaaggagtaatactaagtttcaatacaaaaagagtcgattgaaactcagtattactccgttactggatgagcccgcgttggattaggtagttggtagggtaatggcctaccaagccgacgatctatagctggtctgagaggatggtcagccacactgggactgagacacggcccagactcctacgggaggcagcagtggggaatattggacaatgggcgaaagcctgatccagcgatgccgcgtgagtgatgaaggccttagggttgtaaagctctttcagcaggaaagataatgacggtacctgcagaagaagccccggcaaactccgtgccagcagccgcggtaatacggagggggctagcgttgttcggaattactgggcgtaaagagcgcgtaggcggtttgtaaagttggaagtgaaagcccgaggcttaacctcggaattgcttacaaaactcacaagctagagagcgacaggggatggtggaattcctagtgtagaggtggaattcttagatattaggaggaacaccggtggcgaaggcggccatctgggtcgcatctgacgctgaggcgcgaaagcgtggggagcaaacaggattagataccctggtagtccacgctgtaaacgatgagtgctagatatcagaatgttaattttggtgtcgtagctaacgcattaagcactccgcctggggagtacggccgcaaggctaaaactcaaaggaattgacgggggcccgcacaagcggtggagcatgcggtttaattcgatgctacgcgaaaaaccttaccaacccttgacatggtggtcgcgagaaccagagatggttttcttcagttcggctggaccacacacaggtgttgcatggctgtcgtcagctcgtgtcgtgagatgttgggttaagtcccgcaacgagcgcaaccctcatccttagttgccaacaggtaatgctgggaactctaaggaaactgccggtgataagccggaggaaggtggggacgatgtcaagtcatcatggcccttacgggttgggctacacgcgtgctacaatggtggtgacagagggaagctatagagcgatctaatgcaaatcccaaaaagccatctcagttcggattgcactctgcaactcgagtgcatgaagttggaatcgctagtaatcgcggatcagcatgccgcggtgaatacgttcccgggccttgtacacactgcccgtcacgccatgggagttgattttactcgaagccggtaagctaaccgcaaggaggcagccgaccacagtaaggtcagcgactggggtgaagtcgtaacaaggtagccgtaggggaacctgcggctggattacctcctttcaaag

SEQ ID NO: 7867 - DNA, 1503 bp, Rickettsiales endosymbiont of Peranema trichophorum
  ref <308>: DATABASE ACCESSION NUMBER: NCBI ACCESSION: NZ_SCFA01000050.1
  ref <309>: DATABASE ENTRY DATE: 2019-04-01
  ref <313>: RELEVANT RESIDUES IN SEQ ID NO: (1)..(1503)
caacttgagagtttgatcctggctcagagtgaacgctggcggcgtgcttaacacatgcaagtcgaacgggtaacaatcgtagtaatacggttgttattagtggcaaacgggtgagtaacacatgggaatctgccttgtagtaaggaataactgttagaaatggcagctaataccttatattgcggagacgtgaaagatttatcgctacaagatgagcccatgcaagattagtttgttggtggggtaatggcctaccaagactatgatctttagctggtctgagaggacgatcagccacactggaactgagatacggtccagactcctacgggaggcagcagtggggaatattggacaatgggcgaaagcctgatccagcaacgccgcgtgagtgatgaaggccttagggttgtaaagctcttttagtagggaagataatgacggtacctacagaaaaagccccggctaacttcgtgccagcagccgcggtaatacgaagggggctagcgttactcggaattattgggcgtaaagcgtgcgcaggcggtttagtaagttagaagtgaaagcctgaggctcaacctcagaattgcttttaaaactgcttcactagagtactagaggggatagcggaattcttaatgtagaggtaaaattcatagatattaggaggaacaccggaagcgaaggcggctatctggctagtaactgacgctgttgcacgaaagcgtggggagcaaacaggattagataccctggtagtccacgcagtaaacgatgagtgctaggtgttgggacttgatctcagtgccgcagctaacgcgttaagcactccgcctgaggagtacggtcgcaagattaaaacttaaaggaattgacggggactcgcacaagcggtggaacatgtggtttaattcgatgctacgcgaagaaccttaccaggccttgacatggtagtcgtatggttaagaaattagccagtcagtttggctggactaccacaggtgttgcatggctgtcgtcagctcgtgtcgtgagatgttgggttaagtcccgcaacgagcgcaaccctcatccctagttaccagcgagtaatgtcgggcactttagggaaactgccggtgatgagccggaggaaggtggggatgatgtcaagtcagcatggcccttacggcctgggctacacacgtgttacaatggtagttacaattaggagcaatagggtgacctggagcaaatctataaaaactgcctcagttcggattgtactctgcaactcgggtacatgaagttggaatcgctagtaatcgcagatcagcatgctgtggtgaatacgttctcgggtcttgtacacactgcccgtcaagccatgggagttgattttactttaagtaggtgtgctaaccgcaaggaggcagcctatcacggtgatatcgatgactggggttaagtcgtaacaaggtagccgtaggggaacctgcggctggattacctccttttaag

SEQ ID NO: 7868 - DNA, 1506 bp, Rickettsiales endosymbiont of Stachyamoeba lipophora
  ref <308>: DATABASE ACCESSION NUMBER: NCBI ACCESSION: NZ_CP033611.1
  ref <309>: DATABASE ENTRY DATE: 2019-04-01
  ref <313>: RELEVANT RESIDUES IN SEQ ID NO: (1)..(1506)
aaacttgagagtttgatcctggctcagagtgaacgctggcggcatgctttacacatgcaagtcgaacgaagttatcttagcttgctaggatagcttagtggcatacgggtgagtaacacgtgggaatctgcctaatggtacggaataactgttggaaacgacagctaataccgtatagtctctgcggagtaaagatttatcgccattagatgagcccgcgctagattagctagttggtagggtaatggcctaccaaggcgacgatctatagctggcctgagagggtgaacagccacactgggactgagacacggcccagactcctacgggaggcagcagtggggaatattggacaatgggcgaaagcctgatccagcaatgccgcgtgagtgaagaaggccttagggttgtaaagctcttttagtagggaagagattgacggtacctacagaaaaagcaccggctaacttcgtgccagcagccgcggtaatacgaagggtgctagcgttactcggaattactgggcgtaaagagcgcgtaggcggtcttttaagttggaagtgaaatcccatagctcaactatggaattgctttcaagactggaagactagagaatggtagagggtagtggaattcctggtgtagaggtgaaattcgtagatatcaggaggaacaccggtggcgaaggcggctgcctggaccatttctgacgctgtggcgcgaaagcgtggggagcaaacaggattagataccctggtagtccacgccgtaaacgatgagtgctagatatcagggacatagtctttggtgtcggagctaacgcgttaagcactccgcctggggattacggtcgcaagactaaaactcaaaggaattgacgggggcccgcacaagcagtggagcatgcggtttaattcgatgctacgcgaaaaaccttaccaacccttgacataccggtcgcgggatttagagatagatcccttcagttcggctggaccgagtacaggtgttgcatggctgtcgtcagctcgtgtcgtgagatgttgggttaagtcccgcaacgagcgcaacccctatccttatttgccaacaggttaagctgggaactataaggaaacagctggtgataaaccagaggaaggtggggatgatgtcaagtcatcatggcccttacgggttgggctacacgcgtgctacaatggtggttacagtgggaagcaatagggtgacctggagcaaatccataaaaaccatctcagttcggattgcactctgcaactcgagtgcatgaagtcggaattgctagtaatcgcgtatcagcatgacgcggtgaatacgttcccgggccttgtacacactgcccgtcacgccatgggagttggctttaatcgaagcaagtgagctaaccgcaaggaggcagcttgccacgttagggttaatgactggggtgaagtcgtaacaaggtagccgtaggggaacctgcggctggattacctcctttcaaag

SEQ ID NO: 7869 - DNA, 1514 bp, Risungbinella massiliensis
  ref <308>: DATABASE ACCESSION NUMBER: NCBI ACCESSION: NZ_LN812102.1
  ref <309>: DATABASE ENTRY DATE: 2019-04-01
  ref <313>: RELEVANT RESIDUES IN SEQ ID NO: (1)..(1514)
ttttatcggagagtttgatcctggctcaggacgaacgctggcggcgtgcctaatacatgcaagtcgagcggggttccttcaggaacctagcggcgaacgggtgagtaacacgtgggcaacctgccctcaagcctgggataactccgggaaaccggtgctaataccagataatcattgctcttgcatgagagcaatgtaaaagtttttcgcttgaggatgggcccgcggtgcattagcttgttggtggggtaatggcctaccaaggcgacgatgcatagccgacctgagagggtgaccggccacactgggactgagacacggcccagactcctacgggaggcagcagtagggaattttccgcaatgggcgaaagcctgacggagcaacgccgcgtgagtgatgacggccttcgggttgtaaaactctgttcttagggaagaagttctgacggtacctaaggagaaagccccggctaactacgtgccagcagccgcggtaatacgtagggggcaagcgttgtccggaattattgggcgtaaagcgcgcgcaggcggcgctttaagttgggggttaaaggcaatggctcaaccattgttcgcctccaaaactggagcgcttgagtgcagcagaggaaagtggaattcccggtgtagcggtggaatgcgtagagatcgggaggaacaccagtggcgaaggcgactttctgggctgtaactgacgctgaggcgcgaaagcgtggggagcaaacaggattagataccctggtagtccacgccgtaaacgatgagtgctaggtgttgggggctttcccgccctcagtgccgcagctaacgcattaagcactccgcctggggagtacggccgcaaggctgaaactcaaaggaattgacgggggcccgcacaagcggtggagcatgtggtttaattcgaagcaacgcgaagaaccttaccaaggcttgacatcccgttgaccggggtagagataccccttcccttcggggcaacggtgacaggtggtgcatggttgtcgtcagctcgtgtcgtgagatgttgggttcagtcccgcaacgagcgcaacccttatcgttagttgccagcatttagttgggcactctaacgagacagccggtgaaagccggaggaaggtggggatgacgtcaaatcatcatgccccttatgtcttgggctacacacgtgctacaatggccagtacaaagggttgcgaacccgcgagggggagctaatctcataaagctggtctcagttcggatcgtaggctgcaactcgcctacgtgaagctggaatcgctagtaatcgcggatcagcatgccgcggtgaatccgttcccgggccttgtacacaccgcccgtcacaccacgagagtttgtcacacccgaagtcggtgagagaaccttacggactcagccgccgaaggtggggcagatgattggggtgaagtcgtaacaaggtatccctaccggaaggtggggatggatcacctcctttctatggag

SEQ ID NO: 7870 - DNA, 1487 bp, Rivularia sp. PCC 7116
  ref <308>: DATABASE ACCESSION NUMBER: NCBI ACCESSION: NC_019678.1
  ref <309>: DATABASE ENTRY DATE: 2019-04-01
  ref <313>: RELEVANT RESIDUES IN SEQ ID NO: (1)..(1487)
aaaacggagagtttgatcctggctcaggatgaacgctggcggcgtgcctaacacatgcaagtcgaacggtctcttcggagatagtggcggacgggtgagtaacgcgtgagaatctgcctttaggttcgggacaacagttggaaacgactgctaataccgaatgtgtcgcaagatgaaagattaattgcctaaagatgagctcgcgtctgattagctagttggtgtggtaaaagcataccaaggcgacgatcagtagctggtctgagaggatgatcagccacactgggactgagacacggcccagactcctacgggaggcagcagtggggaattttccgcaatgggcgaaagcctgacggagcaacgccgcgtgagggaggaaggctcttgggttgtaaacctcttttctcaaggaagataatgacggtacttgaggaatcagcatcggctaactccgtgccagcagccgcggtaatacggaggatgcaagcgttatccggaataattgggcgtaaagcgttcgtaggtggttttgtaagtctgctgttaaagcgtgtagctcaactacatataggcagtggaaactacaaaacttgagtgcgttcggggtagagggaattcctggtgtagcggtgaaatgcgtagagatcaggaagaacaccggtggcgaaggcgctctactaggccgcaactgacactgagggacgaaagctaggggagcgaatgggattagataccccagtagtcctagctgtaaacgatggatactaggcgttgtctgtatcgacccggacagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccaaggcttgacatgtccggaagttctgggaaactagaatgtgccttcgggaaccggaacacaggtggtgcatggctgtcgtcagctcgtgtcgtgagatgttgggttaagtcccgcaacgagcgcaaccctcgtccttagttgccagcacttcgggtgggcactttagggagactgccggtgacaaaccggaggaaggtggggatgacgtcaagtcatcatgccccttacgtcttgggctacacacgtactacaatgctatggacaaagagcagccagctagcgatagtgcgctaatctcataaaccatggctcagttcagattgcaggctgcaactcgcctgcatgaagtaggaatcgctagtaattgcaggtcagcatactgcagtgaattcgttcccgggccttgtacacaccgcccgtcacaccatggaagttggtcacgcccgaagtcgttaccctaaccgttcgcggagggggacgccgaaggtaggactgatgactggggtgaagtcgtaacaaggtagccgtaccggaaggtgtggctggatcacctccttt

SEQ ID NO: 7871 - DNA, 1538 bp, Robbsia sp. DHC34
  ref <308>: DATABASE ACCESSION NUMBER: NCBI ACCESSION: NZ_RBZU01000036.1
  ref <309>: DATABASE ENTRY DATE: 2019-04-01
  ref <313>: RELEVANT RESIDUES IN SEQ ID NO: (1)..(1538)
attaaactgaagagtttgatcctggctcagattgaacgctggcggcatgccttacacatgcaagtcgaacggcagcacgggagcaatcctggtggcgagtggcgaacgggtgagtaatacatcggaacgtgtcctgtagtgggggatagcccggcgaaagccggattaataccgcatacgatctacggatgaaagcgggggatcttcggacctcgcgctataggggcggccgatggcggattagctagttggtggggtaaaggcctaccaaggcgacgatccgtagctggtctgagaggacgatcagccacactgggactgagacacggcccagactcctacgggaggcagcagtggggaattttggacaatgggggaaaccctgatccagcaatgccgcgtgtgtgaagaaggccttcgggttgtaaagcacttttgtccggaaagaaaacgttctagctaatatctggagcggatgacggtaccggaagaataagcaccggctaactacgtgccagcagccgcggtaatacgtagggtgcgagcgttaatcggaattactgggcgtaaagcgtgcgcaggcggtttgttaagacggatgtgaaatccccgggctcaacctgggaactgcattcgtgactggcaagctagagtatggcagaggggggtggaattccacgtgtagcagtgaaatgcgtagagatgtggaggaacaccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtacggaaccctgctgagaggtgggggtgctcgaaagagagccgtaacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 7872 - DNA, 1483 bp, Robiginitomaculum antarcticum
  ref <308>: DATABASE ACCESSION NUMBER: NCBI ACCESSION: NZ_KB823011.1
  ref <309>: DATABASE ENTRY DATE: 2019-04-01
  ref <313>: RELEVANT RESIDUES IN SEQ ID NO: (1)..(1483)
caacctgagagtttgattctggctcagaacgaacgctggcggcaggcttaacacatgcaagtcgaacgataagctaccttcgggtagtggacagtggcagacgggtgagtaacgcgtagcaatctacctatcactacggaataacgtcgagaaattgacgctaataccgtatacgtcctccgggagaaagatttatcggtgatagatgaggctgcgttagattagctagatggtgaggtaaaagctcaccatggcgacgatctatagcgggtctgagaggatgatccgccacactgggactgagacacggcccagactcctacgggaggcagcagtggggaatcttggacaatgggcgaaagcctgatccagccatgccgcgtgaatgatgaaggccttagggttgtaaaattctttcgctagggaagataatgacggtacctagtaaagaagccccggctaactccgtgccagcagccgcggtaatacggagggggctagcgttgttcggaattactgggcgtaaagcgtgcgtaggcggattgataagttagaggtgaaatcccagggctcaaccctggaactgcctttaaaactgtcagtctagaattctggagaggtaagtggaattcctagtgtagaggtgaaattcgtagatattaggaggaacaccagaggcgaaggcgacttactggacagatattgacgctgaggcacgaaagtgtgggtagcaaacaggattagataccctggtagtccacaccgtaaacgatgagagctagttgtctgcatgcatgcatgtaggtgacgcagctaacgcattaagctctccgcctggggagtacggtcgcaagattaaaactcaaagaaattgacgggggcccgcacaagcggtggagcatgtggtttaattcgaagcaacgcgcagaaccttacctacccttgacttcctcatcgcgatttccagagatggatttcttcagttaggctggatgagtgacaggtgctgcatggctgtcgtcagctcgtgtcgtgagatgttgggttaagtcccgcaacgagcgcaaccctcgtccttagttgccagcatttagttgggcactctagggagactgccggtgctaagccggaggaaggtggggatgacgtcaagtcctcatggcccttatgggtagggctacacacgtgctacaatggcgctgacagagggttaatccctaaaaggcgtctcagttcggattgtcttctgcaactcgaaggcatgaagttggaatcgctagtaatcgtggatcagcatgccacggtgaatacgttcccgggccttgtacacaccgcccgtcacaccatgggagttggttctacccgaaggtggtgcgctaaccagtttactggaggcagccaaccacggtagggtcagcgactggggtgaagtcgtaacaaggtagccgtaggggaacctgcggctggatcacctcctttctaa

SEQ ID NO: 7873 - DNA, 1540 bp, Robinsoniella peoriensis
  ref <308>: DATABASE ACCESSION NUMBER: NCBI ACCESSION: NZ_FMJR01000011.1
  ref <309>: DATABASE ENTRY DATE: 2019-04-01
  ref <313>: RELEVANT RESIDUES IN SEQ ID NO: (1)..(1540)
tttatttgagagtttgatcctggctcaggatgaacgctggcggcgtgcttaacacatgcaagtcgagcgaagcattaaaaccgatttcttcggaaagaagttttaatgactgagcggcggacgggtgagtaacgcgtgggtgacctgcctcatacagggggataacagacagaaatgtctgctaataccgcataagcgcacagtgctgcatggcacagtgtgaaaaactccggtggtatgagatggacccgcgtctgattagctagttggtaaggtaacggcttaccaaggcgacgatcagtagccggcctgagagggtgaacggccacattgggactgagacacggcccaaactcctacgggaggcagcagtggggaatattgcacaatgggggaaaccctgatgcagcgacgccgcgtgaaggaagaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcatggcaagtctggtgtgaaaggcaggggctcaacccctggactgcattggaaactgtcaggctggagtgcaggagaggtaagtggaattcctagtgtagcggtgaaatgcgtagatattaggaggaacaccagtggcgaaggcgacttactggactgtaactgacgttgaggctcgaaagcgtggggagcaaacaggattagataccctggtagtccacgccgtaaacgatgaatactaggtgtcagggagcaaagctctttggtgccgcagctaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccggacagtaacgtgtcctttccttcgggacagaggtgacaggtggtgcatggttgtcgtcagctcgtgtcgtgagatgttgggttaagtcccgcaacgagcgcaacccttatcttcagtagccagcaattcggttgggcactctggagagactgccagggataacctggaggaaggtggggatgacgtcaaatcatcatgccccttatgatttgggctacacacgtgctacaatggcgtaaacaaagggaagcagccctgtgaaggtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcggaaatgcccgaagtcagtgacccaaccgtaaggagggagctgccgaaggtggagccggtaactggggtgaagtcgtaacaaggtagccgtatcggaaggtgcggctggatcacctcctttctaaggaa

SEQ ID NO: 7874 - DNA, 1540 bp, Robinsoniella sp. KNHs210
  ref <308>: DATABASE ACCESSION NUMBER: NCBI ACCESSION: NZ_JMLZ01000002.1
  ref <309>: DATABASE ENTRY DATE: 2019-04-01
  ref <313>: RELEVANT RESIDUES IN SEQ ID NO: (1)..(1540)
tttatttgagagtttgatcctggctcaggatgaacgctggcggcgtgcttaacacatgcaagtcgagcgaagcattaaaaccgatttcttcggattgaagttctaatgactgagcggcggacgggtgagtaacgcgtgggtgacctgcctcatacagggggataacagacagaaatgtctgctaataccgcataagcgcacagtgctgcatggcacagtgtgaaaaactccggtggtatgagatggacccgcgtctgattagctagttggtaaggtaacggcttaccaaggcgacgatcagtagccggcctgagagggtgaacggccacattgggactgagacacggcccaaactcctacgggaggcagcagtggggaatattgcacaatgggggaaaccctgatgcagcgacgccgcgtgaaggaagaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcatggcaagtctggtgtgaaaggcaggggctcaacccctggactgcattggaaactgtcaggctggagtgcaggagaggtaagtggaattcctagtgtagcggtgaaatgcgtagatattaggaggaacaccagtggcgaaggcgacttactggactgtaactgacgttgaggctcgaaagcgtggggagcaaacaggattagataccctggtagtccacgccgtaaacgatgaatactaggtgtcagggagcaaagctctttggtgccgcagctaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccggacagtaacgtgtcctttccttcgggacagaggtgacaggtggtgcatggttgtcgtcagctcgtgtcgtgagatgttgggttaagtcccgcaacgagcgcaacccttatcttcagtagccagcaattcggttgggcactctggagagactgccagggataacctggaggaaggtggggatgacgtcaaatcatcatgccccttatgatttgggctacacacgtgctacaatggcgtaaacaaagggaagcagccctgtgaaggtgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcggaaatgcccgaagtcagtgacccaaccgtaaggagggagctgccgaaggtggagccggtaactggggtgaagtcgtaacaaggtagccgtatcggaaggtgcggctggatcacctcctttctaaggaa

SEQ ID NO: 7875 - DNA, 1538 bp, Roseateles depolymerans
  ref <308>: DATABASE ACCESSION NUMBER: NCBI ACCESSION: NZ_QUMT01000011.1
  ref <309>: DATABASE ENTRY DATE: 2019-04-01
  ref <313>: RELEVANT RESIDUES IN SEQ ID NO: (1)..(1538)
agatcgaactgtagagtttgatcctggctcagattgaacgctggcggcatgccttacacatgcaagtcgaacggtaacgcggggcaacctggcgacgagtggcgaacgggtgagtaatgtatcggaacgtgcccagttgtgggggataactgctcgaaagagcagctaataccgcatacgacctgagggtgaaagcgggggatcgcaagacctcgcgcaattggagcggccgatatcagattaggtagttggtggggtaaaggcctaccaagcctacgatctgtagctggtctgagaggacgaccagccacactgggactgagacacggcccagactcctacgggaggcagcagtggggaattttggacaatgggggcaaccctgatccagccatgccgcgtgcgggaagaaggccttcgggttgtaaaccgcttttgtcagggaagaaatcctttgagctaatacctcggagggatgacggtacctgaagaataagcaccggctaactacgtgccagcagccgcggtaatacgtagggtgcaagcgttaatcggaattactgggcgtaaagcgtgcgcaggcggttatgcaagacagatgtgaaatccccgggctcaacctgggaactgcatttgtgactgcatagctagagtacggtagagggggatggaattccacgtgtagcagtgaaatgcgtagatatgtggaggaacaccgatggcgaaggcaatcccctggacctgtactgacgctcatgcacgaaagcgtggggagcaaacaggattagataccctggtagtccacgccctaaacgatgtcaactggttgttgggagggtttcttctcagtaacgtagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgccaggaatcttgcagagatgtgagagtgctcgaaagagaacctggacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcatcatggcccttatgggtagggctacacacgtcatacaatggccgggacagagggctgccaacccgcgagggggagctaatcccagaaacccggtcgtagtccggatcgcagtctgcaactcgactgcgtgaagtcggaatcgctagtaatcgcggatcagcttgccgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctag

SEQ ID NO: 7876 - DNA, 1545 bp, Roseburia faecis
  ref <308>: DATABASE ACCESSION NUMBER: NCBI ACCESSION: NZ_CVRR01000056.1
  ref <309>: DATABASE ENTRY DATE: 2019-04-01
  ref <313>: RELEVANT RESIDUES IN SEQ ID NO: (1)..(1545)
ttttaacatgagagtttgatcctggctcaggatgaacgctggcggcgtgcttaacacatgcaagtcgaacgaagcactctatttgattttcttcggaaatgaagattttgtgactgagtggcggacgggtgagtaacgcgtgggtaacctgcctcatacagggggataacagttggaaacgactgctaataccgcataagcgcacaggatcgcatgatccggtgtgaaaaactccggtggtatgagatggacccgcgtctgattagccagttggcagggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccgatgacagagtatgtaatgtactttctcttcggagcatcggtgacaggtggtgcatggttgtcgtcagctcgtgtcgtgagatgttgggttaagtcccgcaacgagcgcaacccctgtccttagtagccagcggttcggccgggcactctagggagactgccagggataacctggaggaaggcggggatgacgtcaaatcatcatgccccttatgacttgggctacacacgtgctacaatggcgtaaacaaagggaagcggagccgtgaggccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttggaaatgcccgaagtcagtgacccaaccgcaaggagggagctgccgaaggcaggttcgataactggggtgaagtcgtaacaaggtagccgtatcggaaggtgcggctggatcacctcctttctaaggaa

SEQ ID NO: 7877 - DNA, 1540 bp, Roseburia hominis
  ref <308>: DATABASE ACCESSION NUMBER: NCBI ACCESSION: NZ_QRVL01000004.1
  ref <309>: DATABASE ENTRY DATE: 2019-04-01
  ref <313>: RELEVANT RESIDUES IN SEQ ID NO: (1)..(1540)
taacatgagagtttgatcctggctcaggatgaacgctggcggcgtgcttaacacatgcaagtcgaacgaagcactttaattgatttcttcggaatgaagtttttgtgactgagtggcggacgggtgagtaacgcgtgggtaacctgcctcatacagggggataacagttggaaacgactgctaataccgcataagcgcacaggattgcatgatccagtgtgaaaaactccggtggtatgagatggacccgcgtctgattagccagttggcggggtaacggcccaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggtaatacgtatggtgcaagcgttatccggatttactgggtgtaaagggagcgcaggcggtacggcaagtctgatgtgaaatcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgaccaagtatgtaatgtactttctcttcggagcagtggtgacaggtggtgcatggttgtcgtcagctcgtgtcgtgagatgttgggttaagtcccgcaacgagcgcaacccctattcttagtagccagcggttcggccgggcactctagggagactgccagggataacctggaggaaggtggggatgacgtcaaatcatcatgccccttatgacttgggctacacacgtgctacaatggcgtaaacaaagggaagcaatcccgcgagggggagcaaatctcaaaaataacgtctcagttcggactgtagtctgcaactcgactacacgaagctggaatcgctagtaatcgcgaatcagaatgtcgcggtgaatacgttcccgggtcttgtacacaccgcccgtcacaccatgggagttggtaatgcccgaagtcagtgacccaaccgcaaggagggagctgccgaaggcaggactgataactggggtgaagtcgtaacaaggtagccgtatcggaaggtgcggctggatcacctcctttctaaggaa

SEQ ID NO: 7878 - DNA, 1543 bp, Roseburia intestinalis
  ref <308>: DATABASE ACCESSION NUMBER: NCBI ACCESSION: NZ_QRQN01000031.1
  ref <309>: DATABASE ENTRY DATE: 2019-04-01
  ref <313>: RELEVANT RESIDUES IN SEQ ID NO: (1)..(1543)
tttaacatgagagtttgatcctggctcaggatgaacgctggcggcgtgcttaacacatgcaagtcgaacgaagcactttatttgatttcttcggaatgaagattttgtgactgagtggcggacgggtgagtaacgcgtgggtaacctgcctcatacagggggataacagttggaaacgactgctaataccgcataagcgcacagggtcgcatgacctggtgtgaaaaactccggtggtatgagatggacccgcgtctgattagccagttggtggggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaaatgacggtacctgactaagaagcaccggctaaatacgtgccagcagccgcggtaatacgtatggtgcaagcgttatccggatttactgggtgtaaagggagcgcaggcggtacggcaagtctgatgtgaaagcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccgatgacagaacatgtaatgtgttttctcttcggagcatcggtgacaggtggtgcatggttgtcgtcagctcgtgtcgtgagatgttgggttaagtcccgcaacgagcgcaacccctattcttagtagccagcggttcggccgggcactctagggagactgccagggataacctggaggaaggtggggatgacgtcaaatcatcatgccccttatgacttgggctacacacgtgctacaatggcgtaaacaaagggaagcgagcctgcgagggggagcaaatctcaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaatgcccgaagtcagtgacccaaccgcaaggagggagctgccgaaggcaggatcgataactggggtgaagtcgtaacaaggtagccgtatcggaaggtgcggctggatcacctcctttctaaggaa

SEQ ID NO: 7879 - DNA, 1543 bp, Roseburia inulinivorans
  ref <308>: DATABASE ACCESSION NUMBER: NCBI ACCESSION: NZ_QRHP01000024.1
  ref <309>: DATABASE ENTRY DATE: 2019-04-01
  ref <313>: RELEVANT RESIDUES IN SEQ ID NO: (1)..(1543)
tttaacatgagagtttgatcctggctcaggatgaacgctggcggcgtgcttaacacatgcaagtcgaacgaagcactttgattgatttcttcggattgaaattttagtgactgagtggcggacgggtgagtaacgcgtgggtaacctgcctcacacagggggataacagttggaaacggctgctaataccgcataagcgcacagtaccgcatggtacagtgtgaaaaactccggtggtgtgagatggacccgcgtctgattagctagttggcagggcaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaaatgacggtacctgactaagaagcaccggctaaatacgtgccagcagccgcggtaatacgtatggtgcaagcgttatccggatttactgggtgtaaagggagcgcaggcggaaggctaagtctgatgtgaaagcccggggctcaaccccggtactgcattggaaactggtcatctagagtgtcggaggggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcggaaagcatggcttttcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatcccggtgaccggacagtaatgtgtccttttcttcggaacaccggtgacaggtggtgcatggttgtcgtcagctcgtgtcgtgagatgttgggttaagtcccgcaacgagcgcaacccttatccccagtagccagcggtttggccgggcactctgaggagactgccagggataacctggaggaaggtggggatgacgtcaaatcatcatgccccttatgacttgggctacacacgtgctacaatggcgtaaacaaagggaagcgagaccgtgaggtggagcaaatcccaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttggaaatgcccgaagtcagtgacccaaccgcaaggagggagctgccgaaggcaggttcgataactggggtgaagtcgtaacaaggtagccgtatcggaaggtgcggctggatcacctcctttctaaggaa

SEQ ID NO: 7880 - DNA, 1540 bp, Roseburia sp. 1XD42-69
  ref <308>: DATABASE ACCESSION NUMBER: NCBI ACCESSION: NZ_RAZG01000130.1
  ref <309>: DATABASE ENTRY DATE: 2019-04-01
  ref <313>: RELEVANT RESIDUES IN SEQ ID NO: (1)..(1540)
aaattgagagtttgatcctggctcaggatgaacgctggcggcgtgcttaacacatgcaagtcgaacgaagcactcttttagatttccttcggggaagaagaaattgtgactgagtggcggacgggtgagtaacgcgtgggcaacctgccccatacagggggataacagccggaaacggctgctaaaaccgcataagcgcacaagggccgcatggcctggtgtgaaaaactccggtggtatgggatgggcccgcgtctgattagctagttggcgggggagaggcccaccaaggcgacgatcagtagccgacctgagagggtggccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaaatgacggtacctgagtaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccgggactgcattggaaactaccgaactagagtgtcggagaggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcggggggcattgcccttcggtgccgcagcaaacgcagtaagtattccacctggggagtacgttcgcaagaatgaaactcaaaggaattgacggggacccgcacaagcggtggagcatgtggtttaattcgaagcaacgcgaagaaccttaccaagccttgacatcctgatgacagagcatgtaatgtgtttttctttcgggacatcagagacaggtggtgcatggttgtcgtcagctcgtgtcgtgagatgttgggttaagtcccgcaacgagcgcaacccttatccttagtagccagcacttcgggtgggcactctagggagactgccagggataacctggaggaaggtggggatgacgtcaaatcatcatgccccttatggcttgggctacacacgtgctacaatggcgtaacaaagggaagcgaacccgtgagggggggcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcgggaatgcccgaagtcagtgacccaacctttggagggagctgccgaaggcaggtctgataactggggtgaagtcgtaacaaggtagccgtatcggaaggtgcggctggatcacctcctttctaaggaa

SEQ ID NO: 7881 - DNA, 1542 bp, Roseburia sp. 499
  ref <308>: DATABASE ACCESSION NUMBER: NCBI ACCESSION: NZ_MJID01000001.1
  ref <309>: DATABASE ENTRY DATE: 2019-04-01
  ref <313>: RELEVANT RESIDUES IN SEQ ID NO: (1)..(1542)
ttttttagagagtttgatcctggctcaggatgaacgctggcggcgtgcttaacacatgcaagtcgaacgaagcacttaacttgattttcttcggaattgattgttctgtgactgagtggcggacgggtgagtaacgcgtgggtaacctgcctcgcacagggggacaacagctggaaacggctgctaataccgcataagcgcacagcttcgcatgaagcagtgtgaaaaactccggtggtgtgagatggacccgcgtctgattagctagttggtgaggtaacggctcaccaaggcgacgatcagtagccgacctgagagggtgaccggccacattgggactgagacacggcccaaactcctacgggaggcagcagtggggaatattacacaatgggcgaaagcctgatgcagcgacgccgcgtgagcgaagaagtatttcggtatgtaaagctctatcagcagggaagaaaatgacggtacctgactaagaagctccggctaaatacgtgccagcagccgcggtaatacgtatggagcaagcgttatccggatttactgggtgtaaagggagcgtaggcggcagggcaagtctgatgtgaaaacccagggctcaaccttgggactgcattggaaactgttcggctggagtgtcggagaggcaagcggaattcctagtgtagcggtgaaatgcgtagatattaggaggaacaccagtggcgaaggcggcttgctggacgattactgacgctgaggctcgaaagcgtggggagcaaacaggattagataccctggtagtccacgccgtaaacgatgaatactaggtgtcggggagcaaagctcttcggtgccgcagcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatcccaatgacctagtatgtaatgtactatctcttcggagcattggtgacaggtggtgcatggttgtcgtcagctcgtgtcgtgagatgttgggttaagtcccgcaacgagcgcaacccttatctttagtagccagcggttcggccgggcactctagagagactgccagggataacctggaggaaggtggggatgacgtcaaatcatcatgccccttatgacttgggctacacacgtgctacaatggcgtaaacaaagggaagcgaagccgtgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggaaatgcccgaagtcagtgacccaaccgcaaggagggagctgccgaaggcaggttcgataactggggtgaagtcgtaacaaggtagccgtatcggaaggtgcggctggatcacctcctttctaaggaa

SEQ ID NO: 7882 - DNA, 1543 bp, Roseburia sp. 831b
  ref <308>: DATABASE ACCESSION NUMBER: NCBI ACCESSION: NZ_MJHW01000006.1
  ref <309>: DATABASE ENTRY DATE: 2019-04-01
  ref <313>: RELEVANT RESIDUES IN SEQ ID NO: (1)..(1543)
tttaacatgagagtttgatcctggctcaggatgaacgctggcggcgtgcttaacacatgcaagtcgaacgaagcactctaattgatttcttcggaatgaagtttttgtgactgagtggcggacgggtgagtaacgcgtgggtaacctgcctcatacagggggataacagttggaaacgactgctaataccgcataagcgcacagcatcgcatggtgcagtgtgaaaaactccggtggtatgagatggacccgcgtctgattagctggttggtggggtaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaaatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactagctgttggggagcattgcttttcagtggcgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccaatgacaagctgtgtaatgcagcctctcttcggagcattggtgacaggtggtgcatggttgtcgtcagctcgtgtcgtgagatgttgggttaagtcccgcaacgagcgcaacccctatccttagtagccagcgggcaagccgggcactctagggagactgccagggataacctggaggaaggtggggatgacgtcaaatcatcatgccccttatgacttgggctacacacgtgctacaatggcgtaaacaaagggaagcgaaaccgtgaggtcgagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagttggtaatgcccgaagtcagtgacccaaccgtaaggagggagctgccgaaggcaggatcgataactggggtgaagtcgtaacaaggtagccgtatcggaaggtgcggctggatcacctcctttctaaggaa

SEQ ID NO: 7883 - DNA, 1543 bp, Roseburia sp. AF02-12
  ref <308>: DATABASE ACCESSION NUMBER: NCBI ACCESSION: NZ_QTXS01000002.1
  ref <309>: DATABASE ENTRY DATE: 2019-04-01
  ref <313>: RELEVANT RESIDUES IN SEQ ID NO: (1)..(1543)
taacatgagagtttgatcctggctcaggatgaacgctggcggcgtgcttaacacatgcaagtcgaacgaagcactttattacgatttcttcggaatgacgatttagtgactgagtggcggacgggtgagtaacgcgtgggtaacctgccttatacagggggataacagttagaaatgactgctaataccgcataagcgcacaggattgcatgatctggtgtgaaaaactccggtggtataagatggacccgcgtctgattagctggttggtgaggtaacggcccaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaaaaatgacggtacctgactaagaagccccggctaactacgtgccagcagccgcggtaatacgtagggggcaagcgttatccggatttactgggtgtaaagggagcgcaggcggtgcggcaagtctgatgtgaaagcccggggctcaaccccgggactgcattggaaactgtcgtacttgagtatcggagaggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcgggggacatagtccttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccggtgacaaagtatgtaatgtactctttcttcggaacaccggtgacaggtggtgcatggttgtcgtcagctcgtgtcgtgagatgttgggttaagtcccgcaacgagcgcaacccctgtccttagtagccagcggttcggccgggcactctagggagactgccagggataacctggaggaaggcggggatgacgtcaaatcatcatgccccttatgacttgggctacacacgtgctacaatggcgtaaacaaagggaagcgaaaaggtgacttctagcaaatcccaaaaataacgtcccagttcggactgtagtctgcaactcgactacacgaagctggaatcgctagtaatcgcgaatcagaatgtcgcggtgaatacgttcccgggtcttgtacacaccgcccgtcacaccatgggagtcgggaatgcccgaagccggtgactcaaccgtaaggagagagccgtcgaaggcaggtctgataactggggtgaagtcgtaacaaggtagccgtatcggaaggtgcggctggatcacctcctttctaaggaa

SEQ ID NO: 7884 - DNA, 1543 bp, Roseburia sp. AF12-17LB
  ref <308>: DATABASE ACCESSION NUMBER: NCBI ACCESSION: NZ_QUHR01000001.1
  ref <309>: DATABASE ENTRY DATE: 2019-04-01
  ref <313>: RELEVANT RESIDUES IN SEQ ID NO: (1)..(1543)
taacatgagagtttgatcctggctcaggatgaacgctggcggcgtgcttaacacatgcaagtcgaacgaagcactttattatgatttcttcggaatgacgatttagtgactgagtggcggacgggtgagtaacgcgtgggtaacctgccttatacagggggataacagttagaaatgactgctaataccgcataagcgcacaggattgcatgatctggtgtgaaaaactccggtggtataagatggacccgcgtctgattagctggttggtgaggtaacggcccaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaaaaatgacggtacctgactaagaagccccggctaactacgtgccagcagccgcggtaatacgtagggggcaagcgttatccggatttactgggtgtaaagggagcgcaggcggtgcggcaagtctgatgtgaaagcccggggctcaaccccgggactgcattggaaactgtcgtacttgagtatcggagaggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcgggggacatagtccttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccggtgacaaagtatgtaatgtactctttcttcggaacaccggtgacaggtggtgcatggttgtcgtcagctcgtgtcgtgagatgttgggttaagtcccgcaacgagcgcaacccctgtccttagtagccagcagttcggctgggcactctagggagactgccagggataacctggaggaaggcggggatgacgtcaaatcatcatgccccttatgacttgggctacacacgtgctacaatggcgtaaacaaagggaagcgaaaaggtgacttctagcaaatcccaaaaataacgtcccagttcggactgtagtctgcaactcgactacacgaagctggaatcgctagtaatcgcgaatcagaatgtcgcggtgaatacgttcccgggtcttgtacacaccgcccgtcacaccatgggagtcgggaatgcccgaagccggtgactcaaccgtaaggagagagccgtcgaaggcaggtctgataactggggtgaagtcgtaacaaggtagccgtatcggaaggtgcggctggatcacctcctttctaaggaa

SEQ ID NO: 7885 - DNA, 1543 bp, Roseburia sp. AF15-21
  ref <308>: DATABASE ACCESSION NUMBER: NCBI ACCESSION: NZ_QUHG01000003.1
  ref <309>: DATABASE ENTRY DATE: 2019-04-01
  ref <313>: RELEVANT RESIDUES IN SEQ ID NO: (1)..(1543)
taacatgagagtttgatcctggctcaggatgaacgctggcggcgtgcttaacacatgcaagtcgaacgaagcactttattatgatttcttcggaatgacgatttagtgactgagtggcggacgggtgagtaacgcgtgggtaacctgccttatacagggggataacagttagaaatgactgctaataccgcataagcgcacaggattgcatgatctggtgtgaaaaactccggtggtataagatggacccgcgtctgattagctggttggtgaggtaacggcccaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaaaaatgacggtacctgactaagaagccccggctaactacgtgccagcagccgcggtaatacgtagggggcaagcgttatccggatttactgggtgtaaagggagcgcaggcggtgcggcaagtctgatgtgaaagcccggggctcaaccccgggactgcattggaaactgtcgtacttgagtatcggagaggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcgggggacatagtccttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccggtgacaaagtatgtaatgtactctttcttcggaacaccggtgacaggtggtgcatggttgtcgtcagctcgtgtcgtgagatgttgggttaagtcccgcaacgagcgcaacccctgtccttagtagccagcggttcggccgggcactctagggagactgccagggataacctggaggaaggcggggatgacgtcaaatcatcatgccccttatgacttgggctacacacgtgctacaatggcgtaaacaaagggaagcgaaagggtgacctctagcaaatcccaaaaataacgtcccagttcggactgtagtctgcaactcgactacacgaagctggaatcgctagtaatcgcgaatcagaatgtcgcggtgaatacgttcccgggtcttgtacacaccgcccgtcacaccatgggagtcgggaatgcccgaagccggtgactcaaccgtaaggagagagccgtcgaaggcaggtctgataactggggtgaagtcgtaacaaggtagccgtatcggaaggtgcggctggatcacctcctttctaaggaa

SEQ ID NO: 7886 - DNA, 1543 bp, Roseburia sp. AF20-18LB
  ref <308>: DATABASE ACCESSION NUMBER: NCBI ACCESSION: NZ_QTWP01000001.1
  ref <309>: DATABASE ENTRY DATE: 2019-04-01
  ref <313>: RELEVANT RESIDUES IN SEQ ID NO: (1)..(1543)
taacatgagagtttgatcctggctcaggatgaacgctggcggcgtgcttaacacatgcaagtcgaacgaagcgctttattataatttcttcggaatgacgatttagtgactgagtggcggacgggtgagtaacgcgtgggtaacctgccttatacagggggataacagttagaaatgactgctaataccgcataagcgcacaggattgcatgatctggtgtgaaaaactccggtggtataagatggacccgcgtctgattagctggttggtgaggtaacggcccaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaaaaatgacggtacctgactaagaagccccggctaactacgtgccagcagccgcggtaatacgtagggggcaagcgttatccggatttactgggtgtaaagggagcgcaggcggtgcggcaagtctgatgtgaaagcccggggctcaaccccgggactgcattggaaactgtcgtacttgagtatcggagaggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcgggggacatagtccttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccggtgacaaagtatgtaatgtactctttcttcggaacaccggtgacaggtggtgcatggttgtcgtcagctcgtgtcgtgagatgttgggttaagtcccgcaacgagcgcaacccctgtccttagtagccagcagttcggctgggcactctagggagactgccagggataacctggaggaaggcggggatgacgtcaaatcatcatgccccttatgacttgggctacacacgtgctacaatggcgtaaacaaagggaagcgaaaaggtgacttctagcaaatcccaaaaataacgtcccagttcggactgtagtctgcaactcgactacacgaagctggaatcgctagtaatcgcgaatcagaatgtcgcggtgaatacgttcccgggtcttgtacacaccgcccgtcacaccatgggagtcgggaatgcccgaagccggtgactcaaccgtaaggagagagccgtcgaaggcaggtctgataactggggtgaagtcgtaacaaggtagccgtatcggaaggtgcggctggatcacctcctttctaaggaa

SEQ ID NO: 7887 - DNA, 1542 bp, Roseburia sp. AF22-2LB
  ref <308>: DATABASE ACCESSION NUMBER: NCBI ACCESSION: NZ_QTWM01000003.1
  ref <309>: DATABASE ENTRY DATE: 2019-04-01
  ref <313>: RELEVANT RESIDUES IN SEQ ID NO: (1)..(1542)
taacatgagagtttgatcctggctcaggatgaacgctggcggcgtgcttaacacatgcaagtcgaacgaagcactttattatgatttcttcggaatgacgatttagtgactgagtggcggacgggtgagtaacgcgtgggtaacctgccttatacagggggataacagttagaaatgactgctaataccgcataagcgcacaggattgcatgatctggtgtgaaaaactccggtggtataagatggacccgcgtctgattagctggttggtgaggtaacggcccaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaaaatgacggtacctgactaagaagccccggctaactacgtgccagcagccgcggtaatacgtagggggcaagcgttatccggatttactgggtgtaaagggagcgcaggcggtgcggcaagtctgatgtgaaagcccggggctcaaccccgggactgcattggaaactgtcgtacttgagtatcggagaggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcgggggacatagtccttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccggtgacaaagtatgtaatgtactctttcttcggaacaccggtgacaggtggtgcatggttgtcgtcagctcgtgtcgtgagatgttgggttaagtcccgcaacgagcgcaacccctgtccttagtagccagcagttcggctgggcactctagggagactgccagggataacctggaggaaggcggggatgacgtcaaatcatcatgccccttatgacttgggctacacacgtgctacaatggcgtaaacaaagggaagcgaaaaggtgacttctagcaaatcccaaaaataacgtcccagttcggactgtagtctgcaactcgactacacgaagctggaatcgctagtaatcgcgaatcagaatgtcgcggtgaatacgttcccgggtcttgtacacaccgcccgtcacaccatgggagtcgggaatgcccgaagccggtgactcaaccgtaaggagagagccgtcgaaggcaggtctgataactggggtgaagtcgtaacaaggtagccgtatcggaaggtgcggctggatcacctcctttctaaggaa

SEQ ID NO: 7888 - DNA, 1542 bp, Roseburia sp. AF22-8AC; identical to SEQ ID NO: 7887
  ref <308>: DATABASE ACCESSION NUMBER: NCBI ACCESSION: NZ_QTWL01000001.1
  ref <309>: DATABASE ENTRY DATE: 2019-04-01
  ref <313>: RELEVANT RESIDUES IN SEQ ID NO: (1)..(1542)

SEQ ID NO: 7889 - DNA, 1543 bp, Roseburia sp. AF25-15LB
  ref <308>: DATABASE ACCESSION NUMBER: NCBI ACCESSION: NZ_QUFN01000003.1
  ref <309>: DATABASE ENTRY DATE: 2019-04-01
  ref <313>: RELEVANT RESIDUES IN SEQ ID NO: (1)..(1543)
taacatgagagtttgatcctggctcaggatgaacgctggcggcgtgcttaacacatgcaagtcgaacgaagcactttattatgatttcttcggaatgacgatttagtgactgagtggcggacgggtgagtaacgcgtgggtaacctgccttatacagggggataacagttagaaatgactgctaataccgcataagcgcacaggattgcatgatctggtgtgaaaaactccggtggtataagatggacccgcgtctgattagcttgttggtgaggtaacggcccaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaaaaatgacggtacctgactaagaagccccggctaactacgtgccagcagccgcggtaatacgtagggggcaagcgttatccggatttactgggtgtaaagggagcgcaggcggtgcggcaagtctgatgtgaaagcccggggctcaaccccgggactgcattggaaactgtcgtacttgagtatcggagaggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcgggggacatagtccttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccggtgacaaagtatgtaatgtactctttcttcggaacaccggtgacaggtggtgcatggttgtcgtcagctcgtgtcgtgagatgttgggttaagtcccgcaacgagcgcaacccctgtccttagtagccagcggttcggccgggcactctagggagactgccagggataacctggaggaaggcggggatgacgtcaaatcatcatgccccttatgacttgggctacacacgtgctacaatggcgtaaacaaagggaagcgaaaaggtgacttctagcaaatcccaaaaataacgtcccagttcggactgtagtctgcaactcgactacacgaagctggaatcgctagtaatcgcgaatcagaatgtcgcggtgaatacgttcccgggtcttgtacacaccgcccgtcacaccatgggagtcgggaatgcccgaagccggtgactcaaccgtaaggagagagccgtcgaaggcaggtctgataactggggtgaagtcgtaacaaggtagccgtatcggaaggtgcggctggatcacctcctttctaaggaa

SEQ ID NO: 7890 - DNA, 1543 bp, Roseburia sp. AF25-25LB
  ref <308>: DATABASE ACCESSION NUMBER: NCBI ACCESSION: NZ_QUFK01000006.1
  ref <309>: DATABASE ENTRY DATE: 2019-04-01
  ref <313>: RELEVANT RESIDUES IN SEQ ID NO: (1)..(1543)
taacatgagagtttgatcctggctcaggatgaacgctggcggcgtgcttaacacatgcaagtcgaacgaagcactttattacgatttcttcggaatgacgatttagtgactgagtggcggacgggtgagtaacgcgtgggtaacctgccttatacagggggataacagttagaaatgactgctaataccgcataagcgcacaggattgcatgatctggtgtgaaaaactccggtggtataagatggacccgcgtctgattagcttgttggtgaggtaacggcccaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaaaaatgacggtacctgactaagaagccccggctaactacgtgccagcagccgcggtaatacgtagggggcaagcgttatccggatttactgggtgtaaagggagcgcaggcggtgcggcaagtctgatgtgaaagcccggggctcaaccccgggactgcattggaaactgtcgtacttgagtatcggagaggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcgggggacatagtccttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccggtgacaaagtatgtaatgtactctttcttcggaacaccggtgacaggtggtgcatggttgtcgtcagctcgtgtcgtgagatgttgggttaagtcccgcaacgagcgcaacccctgtccttagtagccagcggttcggccgggcactctagggagactgccagggataacctggaggaaggcggggatgacgtcaaatcatcatgccccttatgacttgggctacacacgtgctacaatggcgtaaacaaagggaagcgaaaaggtgacttctagcaaatcccaaaaataacgtcccagttcggactgtagtctgcaactcgactacacgaagctggaatcgctagtaatcgcgaatcagaatgtcgcggtgaatacgttcccgggtcttgtacacaccgcccgtcacaccatgggagtcgggaatgcccgaagccggtgactcaaccgtaaggagagagccgtcgaaggcaggtctgataactggggtgaagtcgtaacaaggtagccgtatcggaaggtgcggctggatcacctcctttctaaggaa

SEQ ID NO: 7891 - DNA, 1543 bp, Roseburia sp. AF42-8; identical to SEQ ID NO: 7884
  ref <308>: DATABASE ACCESSION NUMBER: NCBI ACCESSION: NZ_QTVB01000081.1
  ref <309>: DATABASE ENTRY DATE: 2019-04-01
  ref <313>: RELEVANT RESIDUES IN SEQ ID NO: (1)..(1543)

SEQ ID NO: 7892 - DNA, 1544 bp, Roseburia sp. AM16-25
  ref <308>: DATABASE ACCESSION NUMBER: NCBI ACCESSION: NZ_QUCW01000010.1
  ref <309>: DATABASE ENTRY DATE: 2019-04-01
  ref <313>: RELEVANT RESIDUES IN SEQ ID NO: (1)..(1544)
ttaaacatgagagtttgatcctggctcaggatgaacgctggcggcgtgcttaacacatgcaagtcgaacgaagcactttattacgatttcttcggaatgacgatttagtgactgagtggcggacgggtgagtaacgcgtgggtaacctgcctcatacagggggataacagttggaaacgactgctaataccgcataagcgcacggtatcgcatgatacagtgtgaaaaactccggtggtatgagatggacccgcgtctgattagttagttggcgaggtaacggcccaccaaggcaacgatcagtagccgacctgagagggtgaccggccacattgggactgagacacggcccaaactcctacgggaggcagcagtggggaatattgcacaatgggcgaaagcctgatgcagcgacgccgcgtgaacgaagaagtatttcggtatgtaaagttctatcagcagggaagaagaaatgacggtacctgactaagaagctccggctaaatacgtgccagcagccgcggtaatacgtatggagcaagcgttatccggatttactgggtgtaaagggagcgtaggcggtcttataagtctgatgtgaaagcccggggctcaaccccgggactgcattggaaactgtaggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggccaccacaggtggtcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccttctgacaaagtatgtaatgtactcttccttcgggacagaagtgacaggtggtgcatggttgtcgtcagctcgtgtcgtgagatgttgggttaagtcccgcaacgagcgcaacccttgtccttagtagccagcatttaaggtgggcactctagggagactgccagggtgaacctggaggaaggtggggatgacgtcaaatcatcatgccccttatgacttgggctacacacgtgctacaatggcgtaaacaaagggaagcgaaatcgcgaggtggagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttgggaatgcccgaagtcagtgacctaaccgtaaggaaggagctgccgaaggcaggctcgataactggggtgaagtcgtaacaaggtagccgtatcggaaggtgcggctggatcacctcctttctaaggaa

SEQ ID NO: 7893 - DNA, 1441 bp, Roseburia sp. AM23-20
  ref <308>: DATABASE ACCESSION NUMBER: NCBI ACCESSION: NZ_QRHS01000062.1
  ref <309>: DATABASE ENTRY DATE: 2019-04-01
  ref <313>: RELEVANT RESIDUES IN SEQ ID NO: (1)..(1441)
ttttgtgactgagtggcggacgggtgagtaacgcgtgggtaacctgcctcatacagggggataacagttggaaacgactgctaataccgcataagcgcacagcatcgcatgatgcagtgtgaaaaactccggtggtatgagatggacccgcgtctgattagccagttggtggggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaaatgacggtacctgactaagaagcaccggctaaatacgtgccagcagccgcggtaatacgtatggtgcaagcgttatccggatttactgggtgtaaagggagcgcaggcggtacggcaagtctgatgtgaaagcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccattgacctagtatgtaatgtactatctcttcggagcaatggtgacaggtggtgcatggttgtcgtcagctcgtgtcgtgagatgttgggttaagtcccgcaacgagcgcaacccctattcttagtagccagcagttcggctgggcactctagggagactgccagggataacctggaggaaggtggggatgacgtcaaatcatcatgccccttatgacttgggctacacacgtgctacaatggcgtaaacaaagggaagcgagcctgcgagggggagcaaatctcaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaatgcccgaagtcagtgacccaaccgcaaggagggagctgccgaaggcaggatcgataactggggtgaagtcgtaacaaggtagccgtatcggaaggtgcggctggatcacctcctttctaaggaa

SEQ ID NO: 7894 - DNA, 1543 bp, Roseburia sp. AM51-8
  ref <308>: DATABASE ACCESSION NUMBER: NCBI ACCESSION: NZ_QUEY01000011.1
  ref <309>: DATABASE ENTRY DATE: 2019-04-01
  ref <313>: RELEVANT RESIDUES IN SEQ ID NO: (1)..(1543)
ttaaacatgagagtttgatcctggctcaggatgaacgctggcggcgtgcttaacacatgcaagtcgaacgaagcactttattacgatttcttcggaatgacgatttagtgactgagtggcggacgggtgagtaacgcgtgggtaacctgcctcatacagggggataacagttggaaacgactgctaataccgcataagcgcacggtatcgcatgatacagtgtgaaaaactccggtggtatgagatggacccgcgtctgattagctagttggcgaggtaacggcccaccaagcaacgatcagtagccgacctgagagggtgaccggccacattgggactgagacacggcccaaactcctacgggaggcagcagtggggaatattgcacaatgggcgaaagcctgatgcagcgacgccgcgtgaacgaagaagtatttcggtatgtaaagttctatcagcagggaagaagaaatgacggtacctgactaagaagcaccggctaaatacgtgccagcagccgcggtaatacgtatggtgcaagcgttatccggatttactgggtgtaaagggagcgtaggcggttttataagtctgatgtgaaagcccggggctcaaccccgggactgcattggaaactgtaggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggccaccacaggtggtcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccttctgacaaagtatgtaatgtactcttccttcgggacagaagtgacaggtggtgcatggttgtcgtcagctcgtgtcgtgagatgttgggttaagtcccgcaacgagcgcaacccttgtccttagtagccagcatttaaggtgggcactctagggagactgccagggtgaacctggaggaaggtggggatgacgtcaaatcatcatgccccttatgacttgggctacacacgtgctacaatggcgtaaacaaagggaagcgaaatcgcgaggtggagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttgggaatgcccgaagtcagtgacctaaccgtaaggaaggagctgccgaaggcaggctcgataactggggtgaagtcgtaacaaggtagccgtatcggaaggtgcggctggatcacctcctttctaaggaa

SEQ ID NO: 7895 - DNA, 1541 bp, Roseburia sp. AM59-24XD
  ref <308>: DATABASE ACCESSION NUMBER: NCBI ACCESSION: NZ_QUET01000062.1
  ref <309>: DATABASE ENTRY DATE: 2019-04-01
  ref <313>: RELEVANT RESIDUES IN SEQ ID NO: (1)..(1541)
ttaaacatgagagtttgatcctggctcaggatgaacgctggcggcgtgcctaacacatgcaagtcgaacgaagcacatacgacggaactcttcggagggaagatgtatgtgactgagtggcggacgggtgagtaacgcgtgggtaacctgccctatacagggggacaacagttggaaacgactgctaataccgcataagcgcacagtaccgcatggtacagagcgaaaaactccggtggtataggatgggcccgcgtctgattagttagttggcggtgtaacggaccaccaagacgacgatcagtagccggcttgagagagtgaacggccacattgggactgagacacggcccaaactcctacgggaggcagcagtggggaatattgcacaatgggggaaaccctgatgcagcaacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgcaggcggtctggcaagtctgatgtgaaatcccggggctcaactccggaattgcattggaaactgtcagactagagtgccggagaggtaagtggaattcctagtgtagcggtgaaatgcgtagatattaggaggaacaccagtggcgaaggcggcttactggacggtaactgacgctgaggctcgaaagcgtggggagcaaacaggattagataccctggtagtccacgccgtaaacgatgaatactaggtgtcggggcacaaaagtgcttcggtgccgcagcaaacgcattaagtattccacctggggagtacgttcgcaagaatgaaactcaaaggaattgacggggacccgcacaagcggtggagcatgtggtttaattcgaagcaacgcgaagaaccttaccaggccttgacatcctgctgacggatccttaaccggattttctcttcggagcagcagagacaggtggtgcatggttgtcgtcagctcgtgtcgtgagatgttgggttaagtcccgcaacgagcgcaacccctatcctcagtagccagcagttcggctgggcactctgtggagactgccggggataacccggaggaaggtggggatgacgtcaaatcatcatgccccttatggtctgggctacacacgtgctacaatggtgctaacagagagaggcgaagccgcgaggtggagcaaagctcaaaaatggcatctcagttcggattgtagtctgcaactcgactacatgaagctggaatcgctagtaatcgcagatcagaatgctgcggtgaatacgttcccgggtcttgtacacaccgcccgtcacaccatgggagttgggaatgcccgaagtcagtgacctaaccgtaaggaaggagctgccgaaggcaggctcgataactggggtgaagtcgtaacaaggtagccgtatcggaaggtgcggctggatcacctcctttctaag

SEQ ID NO: 7896 - DNA, 1542 bp, Roseburia sp. OM02-15
  ref <308>: DATABASE ACCESSION NUMBER: NCBI ACCESSION: NZ_QULX01000017.1
  ref <309>: DATABASE ENTRY DATE: 2019-04-01
  ref <313>: RELEVANT RESIDUES IN SEQ ID NO: (1)..(1542)
tttttatgagagtttgatcctggctcaggatgaacgctggcggcgtgcttaacacatgcaagtcgaacgaagcactttacttgatctccttcgggattgattgttctgtgactgagtggcggacgggtgagtaacgcgtggataacctgcctcacacagggggataacagttggaaacggctgctaataccgcataagcgcacagcaccgcatggtgcagtgtgaaaaactccggtggtgtgagatggatccgcgtctgattagctggttggcggggtaacggcccaccaaggcgacgatcagtagccggcctgagagggcgaccggccacattgggactgagacacggcccagactcctacgggaggcagcagtggggaatattgcacaatgggggaaaccctgatgcagcgacgccgcgtgagcgatgaagtatttcggtatgtaaagctctatcagcagggaagataatgacggtacctgactaagaagctccggctaaatacgtgccagcagccgcggtaatacgtatggagcaagcgttatccggatttactgggtgtaaagggagcgtaggcggtcctgcaagtctgatgtgaaaacccggggctcaaccccgggactgcattggaaactgtaggactagagtgtcggaggggtaagtggaattcctagtgtagcggtgaaatgcgtagatattaggaggaacaccagtggcgaaggcggcttactggacgaccactgacgctgaggctcgaaagcgtggggagcaaacaggattagataccctggtagtccacgccgtaaacgatgaatactaggtgttggcaggtaagacctgtcggtgccgcagctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccgatgacagagtatgtaatgtactttctcttcggagcatcggtgacaggtggtgcatggttgtcgtcagctcgtgtcgtgagatgttgggttaagtcccgcaacgagcgcaacccctatccccagtagccagcatttcggatgggcactctgtggagactgccagggacaacctggaggaaggtggggatgacgtcaaatcatcatgccccttatgacttgggctacacacgtgctacaatggcgtaaacaaagggaagcgagaccgcgaggtggagcaaatcccaaaaataacgtcccagttcggattgtagtctgcaactcgactacatgaagctggaatcgctagtaatcgcagatcagaatgctgcggtgaatacgttcccgggtcttgtacacaccgcccgtcacaccatgggagtcggaaatgcccgaagccggtggcctaactgcaaagagggagccgtcgaaggcaggtctgataactggggtgaagtcgtaacaaggtagccgtatcggaaggtgcggctggatcacctcctttctaaggaa

SEQ ID NO: 7897 - DNA, 1543 bp, Roseburia sp. OM03-18
  ref <308>: DATABASE ACCESSION NUMBER: NCBI ACCESSION: NZ_QTZK01000001.1
  ref <309>: DATABASE ENTRY DATE: 2019-04-01
  ref <313>: RELEVANT RESIDUES IN SEQ ID NO: (1)..(1543)
taacatgagagtttgatcctggctcaggatgaacgctggcggcgtgcttaacacatgcaagtcgaacgaagcactttattacgatttcttcggaatgacgatttagtgactgagtggcggacgggtgagtaacgcgtgggtaacctgccttatacagggggataacagttagaaatgactgctaataccgcataagcgcacaggattgcatgatctggtgtgaaaaactccggtggtataagatggacccgcgtctgattagctggttggtgaggtaacggcccaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaaaaatgacggtacctgactaagaagccccggctaactacgtgccagcagccgcggtaatacgtagggggcaagcgttatccggatttactgggtgtaaagggagcgcaggcggtgcggcaagtctgatgtgaaagcccggggctcaaccccgggactgcattggaaactgtcgtacttgagtatcggagaggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcgggggacatagtccttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccggtgacaaagtatgtaatgtactctttcttcggaacaccggtgacaggtggtgcatggttgtcgtcagctcgtgtcgtgagatgttgggttaagtcccgcaacgagcgcaacccctgtccttagtagccagcagttcggctgggcactctagggagactgccagggataacctggaggaaggcggggatgacgtcaaatcatcatgccccttatgacttgggctacacacgtgctacaatggcgtaaacaaagggaagcgaaaaggtgacttctagcaaatcccaaaaataacgtcccagttcggactgtagtctgcaactcgactacacgaagctggaatcgctagtaatcgcgaatcagaatgtcgcggtgaatacgttcccgggtcttgtacacaccgcccgtcacaccatgggagtcgggaatgcccgaagccggtgactcaaccgaaaggagagagccgtcgaaggcaggtctgataactggggtgaagtcgtaacaaggtagccgtatcggaaggtgcggctggatcacctcctttctaaggaa

SEQ ID NO: 7898 - DNA, 1543 bp, Roseburia sp. OM03-7AC; identical to SEQ ID NO: 7897
  ref <308>: DATABASE ACCESSION NUMBER: NCBI ACCESSION: NZ_QTZJ01000001.1
  ref <309>: DATABASE ENTRY DATE: 2019-04-01
  ref <313>: RELEVANT RESIDUES IN SEQ ID NO: (1)..(1543)

SEQ ID NO: 7899 - DNA, 1543 bp, Roseburia sp. OM04-10AA
  ref <308>: DATABASE ACCESSION NUMBER: NCBI ACCESSION: NZ_QULT01000057.1
  ref <309>: DATABASE ENTRY DATE: 2019-04-01
  ref <313>: RELEVANT RESIDUES IN SEQ ID NO: (1)..(1543)
taacatgagagtttgatcctggctcaggatgaacgctggcggcgtgcttaacacatgcaagtcgaacgaagcactttattacgatttcttcggaatgacgatttagtgactgagtggcggacgggtgagtaacgcgtgggtaacctgccttatacagggggataacagttagaaatgactgctaataccgcataagcgcacaggattgcatgatccggtgtgaaaaactccggtggtataagatggacccgcgtctgattagctggttggtgaggtaacggcccaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaaaaatgacggtacctgactaagaagccccggctaactacgtgccagcagccgcggtaatacgtagggggcaagcgttatccggatttactgggtgtaaagggagcgcaggcggtgcggcaagtctgatgtgaaagcccggggctcaaccccgggactgcattggaaactgtcgtacttgagtatcggagaggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcgggggacatagtccttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccggtgacaaagtatgtaatgtactctttcttcggaacaccggtgacaggtggtgcatggttgtcgtcagctcgtgtcgtgagatgttgggttaagtcccgcaacgagcgcaacccctgtccttagtagccagcagttcggctgggcactctagggagactgccagggataacctggaggaaggcggggatgacgtcaaatcatcatgccccttatgacttgggctacacacgtgctacaatggcgtaaacaaagggaagcgaaaaggtgacttctagcaaatcccaaaaataacgtcccagttcggactgtagtctgcaactcgactacacgaagctggaatcgctagtaatcgcgaatcagaatgtcgcggtgaatacgttcccgggtcttgtacacaccgcccgtcacaccatgggagtcgggaatgcccgaagccggtgactcaaccgaaaggagagagccgtcgaaggcaggtctgataactggggtgaagtcgtaacaaggtagccgtatcggaaggtgcggctggatcacctcctttctaaggaa

SEQ ID NO: 7900 - DNA, 1543 bp, Roseburia sp. OM04-10BH
  ref <308>: DATABASE ACCESSION NUMBER: NCBI ACCESSION: NZ_QTZI01000009.1
  ref <309>: DATABASE ENTRY DATE: 2019-04-01
  ref <313>: RELEVANT RESIDUES IN SEQ ID NO: (1)..(1543)
taacatgagagtttgatcctggctcaggatgaacgctggcggcgtgcttaacacatgcaagtcgaacgaagcactttattatgatttcttcggaatgacgatttagtgactgagtggcggacgggtgagtaacgcgtgggtaacctgccttatacagggggataacagttagaaatgactgctaataccgcataagcgcacaggattgcatgatccggtgtgaaaaactccggtggtataagatggacccgcgtctgattagctggttggtgaggtaacggcccaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaaaaatgacggtacctgactaagaagccccggctaactacgtgccagcagccgcggtaatacgtagggggcaagcgttatccggatttactgggtgtaaagggagcgcaggcggtgcggcaagtctgatgtgaaagcccggggctcaaccccgggactgcattggaaactgtcgtacttgagtatcggagaggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcgggggacatagtccttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccggtgacaaagtatgtaatgtactctttcttcggaacaccggtgacaggtggtgcatggttgtcgtcagctcgtgtcgtgagatgttgggttaagtcccgcaacgagcgcaacccctgtccttagtagccagcagttcggctgggcactctagggagactgccagggataacctggaggaaggcggggatgacgtcaaatcatcatgccccttatgacttgggctacacacgtgctacaatggcgtaaacaaagggaagcgaaaaggtgacttctagcaaatcccaaaaataacgtcccagttcggactgtagtctgcaactcgactacacgaagctggaatcgctagtaatcgcgaatcagaatgtcgcggtgaatacgttcccgggtcttgtacacaccgcccgtcacaccatgggagtcgggaatgcccgaagccggtgactcaaccgaaaggagagagccgtcgaaggcaggtctgataactggggtgaagtcgtaacaaggtagccgtatcggaaggtgcggctggatcacctcctttctaaggaa

SEQ ID NO: 7901 - DNA, 1543 bp, Roseburia sp. OM04-15AA; identical to SEQ ID NO: 7899
  ref <308>: DATABASE ACCESSION NUMBER: NCBI ACCESSION: NZ_QULO01000025.1
  ref <309>: DATABASE ENTRY DATE: 2019-04-01
  ref <313>: RELEVANT RESIDUES IN SEQ ID NO: (1)..(1543)

SEQ ID NO: 7902 - DNA, 1544 bp, Roseburia sp. TF10-5
  ref <308>: DATABASE ACCESSION NUMBER: NCBI ACCESSION: NZ_QTYW01000044.1
  ref <309>: DATABASE ENTRY DATE: 2019-04-01
  ref <313>: RELEVANT RESIDUES IN SEQ ID NO: (1)..(1544)
tttaacatgagagtttgatcctggctcaggatgaacgctggcggcgtgcttaacacatgcaagtcgaacgaagcactctatttgattttcttcggaaatgaagattttgtgactgagtggcggacgggtgagtaacgcgtgggtaacctgcctcatacagggggataacagttggaaacgactgctaataccgcataagcgcacaggatcgcatgatccggtgtgaaaaactccggtggtatgggatggacccgcgtctgattagccagttggcagggtaacggcctaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagtggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccgatgacagagtatgtaatgtactttctcttcggagcatcggtgacaggtggtgcatggttgtcgtcagctcgtgtcgtgagatgttgggttaagtcccgcaacgagcgcaacccctgtccttagtagccagcggttcggccgggcactctagggagactgccagggataacctggaggaaggcggggatgacgtcaaatcatcatgccccttatgacttgggctacacacgtgctacaatggcgtaaacaaagggaagcaaagccgtgaggccgagcaaatctcaaaaataacgtctcagttcggactgtagtctgcaacccgactacacgaagctggaatcgctagtaatcgcagatcagaatgctgcggtgaatacgttcccgggtcttgtacacaccgcccgtcacaccatgggagttggaaatgcccgaagtcagtgacccaaccgcaaggagggagctgccgaaggcaggttcgataactggggtgaagtcgtaacaaggtagccgtatcggaaggtgcggctggatcacctcctttctaaggaa

SEQ ID NO: 7903 - DNA, 1468 bp, Roseibaca calidilacus
  ref <308>: DATABASE ACCESSION NUMBER: NCBI ACCESSION: NZ_FBYC01000001.1
  ref <309>: DATABASE ENTRY DATE: 2019-04-01
  ref <313>: RELEVANT RESIDUES IN SEQ ID NO: (1)..(1468)
caacttgagagtttgatcctggctcagaacgaacgctggcggcaggcttaacacatgcaagtcgagcgaggacttcggtcctagcggcggacgggtgagtaacgcgtgggaacgtgccctttgctacggaatagtcctgggaaactgggtttaataccgtatgtgcccttcgggggaaagaatttcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagcgatgaaggccttagggttgtaaagctctttcgctggggaagataatgacggtacccagtaaagaagccccggctaactccgtgccagcagccgcggtaatacggagggggctagcgttgttcggaattactgggcgtaaagcgcgcgtaggcggattggaaagttgggggtgaaatcccggggctcaaccccggaactgcctccaaaactatcagtctggagttcgagagaggtgagtggaattgcgagtgtagaggtgaaattcgtagatattcgcaggaacaccagtggcgaaggcggctcactggctcgatactgacgctgaggtgcgaaagtgtggggagcaaacaggattagataccctggtagtccacaccgtaaacgatgaatgccagacgtcggcaagcatgcttgtcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatgggggtcgcggaaccagagatggttctttcagttcggctggaccccacacaggtgctgcatggctgtcgtcagctcgtgtcgtgagatgttcggttaagtccggcaacgagcgcaacccacgtccccagttgccagcattcagttgggcactctggggagactgccgatgataagtcggaggaaggtgtggatgacgtcaagtcctcatggcccttacgggttgggctacacacgtgctacaatggtggtgacagagggataatccctaaaagccatctcagttcggattggggtctgcaactcgaccccatgaagtcggaatcgctagtaatcgcggaacagcatgccgcggtgaatacgttcccgggccttgtacacaccgcccgtcacaccatgggagttgggtctacccgaaggtggtgcgctaaccagcaatggaggcagccaaccacggtaggctcagcgactggggtgaagtcgtaacaaggtagccgtaggggaacctgcggctggatcacctcctttctaa

SEQ ID NO: 7904 - DNA, 1467 bp, Roseibaca ekhonensis
  ref <308>: DATABASE ACCESSION NUMBER: NCBI ACCESSION: NZ_UIHC01000087.1
  ref <309>: DATABASE ENTRY DATE: 2019-04-01
  ref <313>: RELEVANT RESIDUES IN SEQ ID NO: (1)..(1467)
caacttgagagtttgatcctggctcagaacgaacgctggcggcaggcttaacacatgcaagtcgagcgaagccttcgggcttagcggcggacgggtgagtaacgcgtgggaacgtgccctttgctacggaatagtccctggaaacggggtttaataccgtatgtgctcttcggaggaaagaatttcggcaaaggatcggcccgcgttggattaggtagttggtggggtaaaggcctaccaagccgacgatccatagctggtttgagaggatgatcagccacactgggactgagacacggcccagactcctacgggaggcagcagtggggaatcttagacaatgggggcaaccctgatctagccatgccgcgtgagcgatgaaggccttagggttgtaaagctctttcgctggggaagataatgacggtacccagtaaagaagccccggctaactccgtgccagcagccgcggtaatacggagggggctagcgttgttcggaattactgggcgtaaagcgcgcgtaggcggattggaaagttgggggtgaaatcccggggctcaaccccggaactgcctccaaaactatcagtcttgagttcgagagaggtgagtggaattgcgagtgtagaggtgaaattcgtagatattcgcaggaacaccagtggcgaaggcggctcactggctcgatactgacgctgaggtgcgaaagtgtggggagcaaacaggattagataccctggtagtccacaccgtaaacgatgaatgccagacgtcgggcagcatgctgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggatatcgcgggaccggagacggttctttcagttcggctggatatcacacaggtgctgcatggctgtcgtcagctcgtgtcgtgagatgttcggttaagtccggcaacgagcgcaacccacgtccccagttgccagcattcagttgggcactctgaggagactgccgatgataagtcggaggaaggtgtggatgacgtcaagtcctcatggcccttacgggttgggctacacacgtgctacaatggtggtgacagagggataatccctaaaagccatctcagttcggattggggtctgcaactcgaccccatgaagtcggaatcgctagtaatcgcggaacagcatgccgcggtgaatacgttcccgggccttgtacacaccgcccgtcacaccatgggagttgggtctacccgaaggtggtgcgctaaccagcaatggaggcagccaaccacggtaggctcagcgactggggtgaagtcgtaacaaggtagccgtaggggaacctgcggctggatcacctcctttcta

SEQ ID NO: 7905 - DNA, 1471 bp, Roseibacterium elongatum
  ref <308>: DATABASE ACCESSION NUMBER: NCBI ACCESSION: NZ_CP004372.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgagatcttcggatctagcggcggacgggtgagtaacgcgtgggaacgtgcccttctctacggaatagtcccgggaaactgggtttaataccgtatacgcccttcgggggaaagaatttcggagaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccctagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggattagtcagtcagaggtgaaatcccagggctcaaccctggaactgcctttgatactgctagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggatgcttgcatctcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccctgtcgcggttttccgagaggaattccttcagttcggctggacaggtgacaggtgctgcatggctgtcgtcagctcgtgtcgtgagatgttcggttaagtccggcaacgagcgcaacccacacccttagttgccagcagttcggctgggcactctaggggaactgcccgtgataagcgggaggaaggtgtggatgacgtcaagtcctcatggcccttacgggttgggctacacacgtgctacaatggcagtgacaatggggtaatcccaaaaagctgtctcagttcggattgtcctctgcaactcgagggcatgaagtcggaatcgctagtaatcgcgtaacagcatgacgcggtgaatacgttcccgggccttgtacacaccgcccgtcacaccatgggagttgggtctacccgacggccgtgcgctaacccttttggggggcagcggaccacggtaggctcagcgactggggtgaagtcgtaacaaggtagccgtaggggaacctgcggctggatcacctcctttctaa

SEQ ID NO: 7906 - DNA, 1492 bp, Roseibium sp. TrichSKD4
  ref <308>: DATABASE ACCESSION NUMBER: NCBI ACCESSION: NZ_GL476306.1
  ref <309>: DATABASE ENTRY DATE: 2019-04-01
  ref <313>: RELEVANT RESIDUES IN SEQ ID NO: (1)..(1492)
ttaaacctgagagtttgatcctggctcagaacgaacgctggcggcaggcttaacacatgcaagtcgaacgaagtcttcggacttagtggcagacgggtgagtaacgcgtgggaacctaccctttggtacggaatagctccgggaaactggaattaataccgtatgctccctacgggggaaagatttatcgccaaaggatgggcccgcgttggattagctagttggtggggtaatggcctaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcagcgaggaggataatgacgttactcgcagaagaagccccggctaacttcgtgccagcagccgcggtaatacgaagggggctagcgttgttcggaatcactgggcgtaaagcgcacgtaggcggattgataagttaggggtgaaatcccggggctcaacctcggaactgcctttgatactgtcagtcttgagtccgagagaggtgagtggaactccgagtgtagaggtgaaattcgtagatattcggaagaacaccagtggcgaaggcggctcactggctcggtactgacgctgaggtgcgaaagcgtggggagcaaacaggattagataccctggtagtccacgccgtaaacgatggaagctagctgtcaggtagcatgctatttggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagctcttgacatttggtgctacatccggagacggatggttcccttcggggacgccaggacaggtgctgcatggctgtcgtcagctcgtgtcgtgagatgttgggttaagtcccgcaacgagcgcaaccctcgcccttagttgccagcatttagttgggcactctagggggactgccggtgataagccgagaggaaggtggggatgacgtcaagtcctcatggcccttacgggctgggctacacacgtgctacaatggcggtgacaatgggcagcgaacccgcgagggggagctaatctccaaaagccgtctcagttcggattgttctctgcaactcgagagcatgaagttggaatcgctagtaatcgcgtaacagcatgacgcggtgaatacgttcccgggccttgtacacaccgcccgtcacaccatgggagttgggtttacccgaaggcagtgcgctaaccgcaagggggcagctgaccacggtaggctcagcgactggggtgaagtcgtaacaaggtagccctaggggaacctggggctggatcacctcctttctaagga

SEQ ID NO: 7907 - DNA, 1468 bp, Roseicitreum antarcticum
  ref <308>: DATABASE ACCESSION NUMBER: NCBI ACCESSION: NZ_FNOM01000003.1
  ref <309>: DATABASE ENTRY DATE: 2019-04-01
  ref <313>: RELEVANT RESIDUES IN SEQ ID NO: (1)..(1468)
caacttgagagtttgatcctggctcagaacgaacgctggcggcaggcctaacacatgcaagtcgaacggcaccttcgggtgtagtggcggacgggttagtaacgcgtgggaacgtgcccttctctacggaatagcctcgggaaactgggtttaataccgtatacgctcttcggaggaaagatttatcggagaaggatcggcccgcgttggattaggtagttggtggggtaatggcctaccaagcctacgatccatagctggtttgagaggatgatcagcaacactgggactgagacacggcccagactcctacgggaggcagcagtggggaatcttagacaatgggggaaaccctgatctagccatgccgcgtgagcgatgaaggccttagggttgtaaagctctttcagatgggaagataatgacggtaccatcagaagaagccccggctaactccgtgccagcagccgcggtaatacggagggggctagcgttgttcggaattactgggcgtaaagcgcgcgtaggcggattggaaagttgggggtgaaatcccggggctcaacctcggaactgcctccaaaactatcagtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatgggtatcgcggaaccagagatggttctttcagttcggctggataccacacaggtgctgcatggctgtcgtcagctcgtgtcgtgagatgttcggttaagtccggcaacgagcgcaacccacgtccctagttgccagcattcagttgggcactctatggaaactgccgatgataagtcggaggaaggtgtggatgacgtcaagtcctcatggcccttacgggttgggctacacacgtgctacaatggtagtgacagtgggttaatcccaaaaagctatctcagttcggattggggtctgcaactcgaccccatgaagtcggaatcgctagtaatcgcggaacagcatgccgcggtgaatacgttcccgggccttgtacacaccgcccgtcacaccatgggagttgggtctacccgaaggcggtgcgccaaccagcaatgggggcagccgaccacggtaggctcagcgactggggtgaagtcgtaacaaggtagccgtaggggaacctgcggctggatcacctcctttcta

SEQ ID NO: 7908 - DNA, 1473 bp, Roseicyclus mahoneyensis
  ref <308>: DATABASE ACCESSION NUMBER: NCBI ACCESSION: NZ_QGGW01000024.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcaggcctaacacatgcaagtcgagcgagaccttcgggtctagcggcggacgggtgagtaacgcgtgggaacgtgcccttctctacggaatagtcccgggaaactgggtttaataccgtatacgcccttcgggggaaagatttatcggagaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgacgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcgggctgttaagtcgggggtgaaatcccggggctcaaccccggaactgccctcgatactggcagcctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcaggttgcttgcaacttggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggaggggaccgtttccagagatggatccattctcgtaagagacccctcacacaggtgctgcatggctgtcgtcagctcgtgtcgtgagatgttcggttaagtccggcaacgagcgcaacccacatccttagttgccagcaggtcaagctgggcactctagggaaactgcccgtgataagcgggaggaaggtgtggatgacgtcaagtcctcatggcccttacgggttgggctacacacgtgctacaatggtggtgacaatgggttaatcccaaaaagccatctcagttcggattggggtctgcaactcgaccccatgaagtcggaatcgctagtaatcgcgtaacagcatgacgcggtgaatacgttcccgggccttgtacacaccgcccgtcacaccatgggagttggttctacctgacggccgtgcgctaacccttcggggaggcagcggaccacggtaggatcagcgactggggtgaagtcgtaacaaggtagccgtaggggaacctgcggctggatcacctcctttctaa

SEQ ID NO: 7909 - DNA, 1481 bp, Roseiflexus castenholzii
  ref <308>: DATABASE ACCESSION NUMBER: NCBI ACCESSION: NC_009767.1
  ref <309>: DATABASE ENTRY DATE: 2019-04-01
  ref <313>: RELEVANT RESIDUES IN SEQ ID NO: (1)..(1481)
atgaagagtttgatcctggctcaggacgaacgctggcggcgtgcctaatgcatgcaagtcgaacgcacgcgcttcggcgcgtgagtggcgcacggctgagtaacacgtgggaacccgccctccggtgggggataacgagacgaaagtcgcgctaatcccgcatacgtccgcaaggggaaagcgcttcggcgcgccggaggaggggcctgcggcccatcaggtggttggtggggtaacggcctaccaagccgatgacgggtagctggtctgggaggatgaccagccagactgggactgagacacggcccagactcctacgggaggcagcagcaaggaattttcggcaatgggcgcaagcctgaccgagcaacgccgcgtgcgggatgacggccttcgggttgtaaaccgcttttcggggggacgactacgacggtacccccggaagaagccccggctaactctgtgccagcagccgcggtaagacagagggggcgagcgttgtccggagttactgggcgtaaagcgcgcgcaggcggtggtctcagtgtcgtgtgaaagcccccggctcaaccgggggaggtcatggcaaactagacgactagagcggcggagaggcccctcgaattgccggtgtagcggtgaaatgcgtagagatcggcaggaagaccaagggggaagccagggggctggccgctggctgacgctgaggcgcgacagcgtggggagcaaaccggattagatacccgggtagtccacgccgtaaacgatgaccactcggcgtgtggcgactattgacgtcgcggcgcgcctaagcttacgcgtgaagtggtccgcctgggaactacgagcgcaagcttaaaactcaaaggaattgacgggggcccgcacaagcagcggagcgtgtggtttaattcgaggcaacccgaagaaccttacccaggctggacatgacggtgcaggcggcggaaacgtcgcggccttcgagggaccgtcacaggtgctgcatggctgtcgtcagctcgtgtcgtgagatgttgggttaagtcccgcaacgagcgcaacccctgcggttagttaccggtgtctaaccggactgcccttcggggaggaaggcggggatgacgtcaagtccgcatggccctgacgcctggggcgacacacacgctacaatggcgccgacaatgcgtggcgaccgcgcgagcggaggcaaatcgccaaacggcgtctcagtgcagatcgggggctgcaactcgcccccgtgaaggcggagttgctagtaaccgcgtatcagccatggcgcggtgaatacgtacccgggccttgtacacaccgcccgtcacgtcatgggagttgtcaatgcctgaagtccgtgcgctaaccgtcaggaggcagcggccgagggcaggggcagcgactgggacgaagtcgtaacaaggtagccgtaccggaaggtgcggctggatcacctcctttctagggag

SEQ ID NO: 7910 - DNA, 1482 bp, Roseiflexus sp. RS-1
  ref <308>: DATABASE ACCESSION NUMBER: NCBI ACCESSION: NC_009523.1
  ref <309>: DATABASE ENTRY DATE: 2019-04-01
  ref <313>: RELEVANT RESIDUES IN SEQ ID NO: (1)..(1482)
aatgaagagtttgatcctggctcaggacgaacgctggcggcgtgcctaatgcatgcaagtcgcacgcacccgcttcggcgggtgagtggcgcacggctgagtaacacgtgggaacccgccccccggtgggggataacgcgacgaaagttgcgctaatcccgcatacgtccttcgggggaaagcgcagtgcgcgccgggggaggggcctgcggcccatcaggtcgttggtggggtaagggcctaccaagccgatgacgggtagctggtctgggaggatgaccagccagactgggactgagacacggcccagactcctacgggaggcagcagcaaggaattttcggcaatgggcgcaagcctgaccgagcaacgccgcgtgcgggatgacggccttcgggttgtaaaccgcttttcggggggacgaccctgacggtacccccggaatcagccccggctaactctgtgccagcagccgcggtaagacagagggggcgagcgttgtccggagtcactgggcgtaaagcgcgcgcaggcggcaacctaagtgtcgtgtgaaagcccccggctcaaccgggggaggccatggcaaactgggtcgctcgagctgcggagaggcccctcgaattgccggtgtagcggtgaaatgcgtagagatcggcaggaagaccaagggggaagccagggggctggccgcaggctgacgctgaggcgcgacagcgtggggagcaaaccggattagatacccgggtagtccacgccgtaaacgatgaccactcggcgtgtggcgactattgacgtcgcggcgcgccctagctcacgcgataagtggtccgcctgggaactacgagcgcaagcttaaaactcaaaggaattgacgggggcccgcacaagcagcggagcgtgtggtttaattcgacgcaacccgaagaaccttacccagactggacatgacggtgcagacggcggaaacgtcgtcgcctgcgagggtccgtcacaggtgctgcatggctgtcgtcagctcgtgtcgtgagatgttgggttaagtcccgcaacgagcgcaacccctgcggttagttacccgtgtctaaccggactgcccttcggggaggaaggcggggatgacgtcaagtccgcatggcccttacgtctggggcgacacacacgctacaatggcgccgacaatgcgtcgctcccgcgcaagcggatgctaatcgccaaacggcgccccagtgcagatcgggggctgcaactcgcccccgtgaaggcggagttgctagtaaccgcgtatcagccatggcgcggtgaatacgtacccgggccttgtacacaccgcccgtcacgtcatgggagttgtcaatgcctgaagtccgccagctaaccggtttccggaggcagcggccgagggcaggggcagcgactgggacgaagtcgtaacaaggtagccgtaccggaaggtgcggctggatcacctcctttctaggg

SEQ ID NO: 7911 - DNA, 1473 bp, Roseinatronobacter thiooxidans
  ref <308>: DATABASE ACCESSION NUMBER: NCBI ACCESSION: NZ_QKZQ01000047.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcaggcttaacacatgcaagtcgaacgaagccttcgggcttagtggcggacgggtgagtaacgcgtgggaacgtgccctttgctacggaatagtcccgggaaactgggtttaataccgtatattctctacggaggaaagatttatcggcaaaggatcggcccgcgttggattaggtagttggtggggtaatggcctaccaagcccgcgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcgctggggaagataatgacggtacccagtaaagaagccccggctaactccgtgccagcagccgcggtaatacggagggggctagcgttgttcggaattactgggcgtaaagcgcgcgtaggcggattggaaagttgggggtgaaatcccggggctcaaccccggaactgcctccaaaactatcagtctggagttcgagagaggtgagtggaattgcgagtgtagaggtgaaattcgtagatattcgcaggaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatgggtatcgcgggacgagagatcgtcctttcagttcggctggataccacacaggtgctgcatggctgtcgtcagctcgtgtcgtgagatgttcggttaagtccggcaacgagcgcaacccacgtccttagttgccagcaggtcaagctgggcactctaaggaaactgccgatgataagtcggaggaaggtgtggatgacgtcaagtcctcatggcccttacgggttgggctacacacgtgctacaatggtagtgacagtgggataatcccaaaaagctatctcagttcggattggggtctgcaactcgaccccatgaagtcggaatcgctagtaatcgcggaacagcatgccgcggtgaatacgttcccgggccttgtacacaccgcccgtcacaccatgggagttgggtctacccgaagatggtgcgctaacccagcaatgggaggcagccagccacggtaggctcagcgactggggtgaagtcgtaacaaggtagccgtaggggaacctgcggctggatcacctcctttctaa

SEQ ID NO: 7912 - DNA, 1466 bp, Roseisalinus antarcticus
  ref <308>: DATABASE ACCESSION NUMBER: NCBI ACCESSION: NZ_FWFZ01000091.1
  ref <309>: DATABASE ENTRY DATE: 2019-04-01
  ref <313>: RELEVANT RESIDUES IN SEQ ID NO: (1)..(1466)
caacttgagagtttgatcctggctcagaacgaacgctggcggcaggcttaacacatgcaagtcgagcgagatcttcggatctagcggcggacgggtgagtaacgcgtgggaacgtacctttctctacggaatagtcccgggaaactgggtttaataccgtatacgcccttcgggggaaagatttatcggggaaagatcggcccgcgtctgattaggtagttggtggggtaatggcctaccaagcctacgatcagtagctggtttgagaggatgatcagccacactgggactgagacacggcccagactcctacgggaggcagcagtggggaatcttagacaatgggggcaaccctgatctagccatgccgcgtgtgtgatgaaggccttagggtcgtaaagcactttcgctggggaagataatgactgtacccagtaaagaaaccccggctaactccgtgccagcagccgcggtaatacggagggggttagcgttgttcggaattactgggcgtaaagcgcgcgtaggcggactatccagtcagaggtgaaatcccagggctcaaccctggaactgcctttgatactagtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcagggggcttgccctttggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgaccgccagagagatttggtttcccttcggggcacagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggtagtgacaatgggttaatcccaaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgccaacctttacagggggcagcggaccacggtgagctcagcgactggggtgaagtcgtaacaaggtagccgtaggggaacctgcggctggatcacctcctttctaa

SEQ ID NO: 7913 - DNA, 1467 bp, Roseivivax halodurans
  ref <308>: DATABASE ACCESSION NUMBER: NCBI ACCESSION: NZ_JALZ01000099.1
  ref <309>: DATABASE ENTRY DATE: 2019-04-01
  ref <313>: RELEVANT RESIDUES IN SEQ ID NO: (1)..(1467)
caacttgagagtttgatcctggctcagaacgaacgctggcggcaggcttaacacatgcaagtcgagcgaagccttcgggcttagcggcggacgggtgagtaacgcgtgggaacgtgcccattcctgcggaataggccctggaaacggggtttaataccgcatacgcccttcgggggaaagaatttcggggatggatcggcccgcgttggattaggtagttggtggggtaaaagcctaccaagccgacgatccatagctggttttagaggatgatcagccacactgggactgagacacggcccagactcctacgggaggcagcagtggggaatcttagacaatgggggcaaccctgatctagccatgccgcgtgagtgatgaaggtcttaggatcgtaaagctctttcgccggggaagataatgacggtacccggtaaagaaaccccggctaactccgtgccagcagccgcggtaatacggagggggttagcgttgttcggaattactgggcgtaaagcgcacgtaggcggactggaaagttgggggtgaaatcccggggctcaacctcggaactgcctccaaaactatcagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcggctcgcatgcgggtcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctcggaccgctccggagacggagtttccacttcggtggccgagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcggtgacagtgggttaatcccaaaaagccgtctcagttcggattgtcctctgcaactcgagggcatgaagtcggaatcgctagtaatcgcggaacagcatgccgcggtgaatacgttcccgggccttgtacacaccgcccgtcacaccatgggagttggttttacctgacgacggtgcgctaacccttcggggaggcagccggccacggtaagatcagcgactggggtgaagtcgtaacaaggtagccgtaggggaacctgcggctggatcacctcctttctaa

SEQ ID NO: 7914 - DNA, 1467 bp, Roseivivax halotolerans
  ref <308>: DATABASE ACCESSION NUMBER: NCBI ACCESSION: NZ_FOXV01000030.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcttaacacatgcaagtcgagcgaagccttcgggcttagcggcggacgggtgagtaacgcgtgggaacgtgcccttctgtgcggaatagtccctggaaacggggtttaataccgcatacgccctttgggggaaagatttatcgcagaaggatcggcccgcgtctgattaggtagttggtggggtaatggcctaccaagccgacgatcagtagctggttttagaggatgatcagccacactgggactgagacacggcccagactcctacgggaggcagcagtggggaatcttagacaatgggcgcaagcctgatctagccatgccgcgtgagtgatgaaggtcttaggatcgtaaagctctttcgctggggaagataatgacggtacccagtaaagaaaccccggctaactccgtgccagcagccgcggtaatacggagggggttagcgttgttcggaattactgggcgtaaagcgcacgtaggcggatcggaaagttgggggtgaaatcccggggctcaacctcggaactgccttcaaaactatcggtctagagttcgagagaggtgagtggaattgcgagtgtagaggtgaaattcgtagatattcgcaggaacaccagtggcgaaggcggctcactggctcgatactgacgctgaggtgcgaaagtgtggggagcaaacaggattagataccctggtagtccacaccgtaaacgatgaatgccagtcgtcgggcagcatgctgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatcgggagaccgatggttcccttcggggacgcagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggtggtgacagtgggttaatccccaaaagccatctcagttcggattgtcctctgcaactcgagggcatgaagtcggaatcgctagtaatcgcgtaacagcatgacgcggtgaatacgttcccgggccttgtacacaccgcccgtcacaccatgggagttggttttacctgacgacggtgcgctaaccttcgggaggcagccggccacggtaagatcagcgactggggtgaagtcgtaacaaggtagccgtaggggaacctgcggctggatcacctcctttctaa

SEQ ID NO: 7915 - DNA, 1466 bp, Roseivivax isoporae
  ref <308>: DATABASE ACCESSION NUMBER: NCBI ACCESSION: NZ_JAME01000086.1
  ref <309>: DATABASE ENTRY DATE: 2019-04-01
  ref <313>: RELEVANT RESIDUES IN SEQ ID NO: (1)..(1466)
caacttgagagtttgatcctggctcagaacgaacgctggcggcaggcctaacacatgcaagtcgagcgaagccttcgggcttagcggcggacgggtgagtaacgcgtgggaacgtgcccttccctgcggaataggccctggaaacggggtttaataccgcatacgcccttcgggggaaagatttatcggggaaggatcggcccgcgtctgattaggtagttggtggggtaatggcctaccaagcctacgatcagtagctggttttagaggatgatcagccacactgggactgagacacggcccagactcctacgggaggcagcagtggggaatcttagacaatgggcgcaagcctgatctagccatgccgcgtgagtgatgaaggccttagggtcgtaaagctctttcgccggggatgataatgacagtacccggtaaagaaaccccggctaactccgtgccagcagccgcggtaatacggagggggttagcgttgttcggaattactgggcgtaaagcgcgcgtaggcggattggaaagttgggggtgaaatcccggggctcaacctcggaacggcctccaaaactcccagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggcgcgcatgcgtgtcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctcggaccgctccggagacggagtttccacttcggtggccgagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcggtgacaatgggttaatccccaaaagccgtctcagttcggattgtcctctgcaactcgagggcatgaagtcggaatcgctagtaatcgcgtaacagcatgacgcggtgaatacgttcccgggccttgtacacaccgcccgtcacaccatgggagttggttttacctgacgacggtgcgctaaccttcgggaggcagccggccacggtaagatcagcgactggggtgaagtcgtaacaaggtagccgtaggggaacctgcggctggatcacctcctttctaa

SEQ ID NO: 7916 - DNA, 1455 bp, Roseivivax jejudonensis
  ref <308>: DATABASE ACCESSION NUMBER: NCBI ACCESSION: NZ_FWFK01000013.1
  ref <309>: DATABASE ENTRY DATE: 2019-04-01
  ref <313>: RELEVANT RESIDUES IN SEQ ID NO: (1)..(1455)
caacttgagagtttgatcctggctcagaacgaacgctggcggcaggcttaacacatgcaagtcgtgcgaggtcttcggacctagcggcggacgggtgagtaacgcgtgggaacgtgcccttcggttcaggatagccccgggaaactgggattaatactggatacgcccttcgggggaacgaaggatcggcccgcgttagattaggtagttggtggggtaacggcctaccaagcctacgatctatagctggttttagaggatgatcagccacactgggactgagacacggcccagactcctacgggaggcagcagtggggaatcttagacaatgggcgcaagcctgatctagccatgccgcgtgtgtgatgaaggccctagggtcgtaaagcactttcgccggggaagataatgacggtacccggtaaagaaaccccggctaactccgtgccagcagccgcggtaatacggagggggttagcgttgttcggaattactgggcgtaaagcgcgcgtaggcggactggaaagttgggggtgaaatcccggggctcaaccccggaactgcctccaaaactatcagtctggagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcgggcagcatgctgttcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctcggaccgctccggagacggagtttccacttcggtggccgagtgacaggtgctgcatggctgtcgtcagctcgtgtcgtgagatgttcggttaagtccggcaacgagcgcaacccacatccttagttgccagtagttcggctgggcactctagggaaactgcccgtgataagcgggaggaaggtgtggatgacgtcaagtcctcatggcccttacgggttgggctacacacgtgctacaatggcggtgacagtgggttaatcccaaaaagccgtctcagttcggattgtcctctgcaactcgagggcatgaagtcggaatcgctagtaatcgcggaacagcatgccgcggtgaatacgttcccgggccttgtacacaccgcccgtcacaccatgggagttggttttacctgacgacggtgcgctaaccttcgggaggcagccggccacggtaagatcagcgactggggtgaagtcgtaacaaggtagccgtaggggaacctgcggctggatcacctcctttctaa

SEQ ID NO: 7917 - DNA, 1467 bp, Roseivivax lentus
  ref <308>: DATABASE ACCESSION NUMBER: NCBI ACCESSION: NZ_FTOQ01000032.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcttaacacatgcaagtcgagcgagaccttcgggtctagcggcggacgggtgagtaacgcgtgggaacgtgcccttctctacggaatagtcccgggaaactgggtttaataccgtatacgcccttcgggggaaagatttatcggagaaggatcggcccgcgttagattaggtagttggtggggtaatggcctaccaagcctacgatctatagctggttttagaggatgatcagccacactgggactgagacacggcccagactcctacgggaggcagcagtggggaatcttagacaatgggcgcaagcctgatctagccatgccgcgtgagtgatgaaggccttagggtcgtaaagctctttcgctggggaagataatgacggtacccagtaaagaaaccccggctaactccgtgccagcagccgcggtaatacggagggggttagcgttgttcggaattactgggcgtaaagcgcacgtaggcggactggaaagttgggggtgaaatcccggggctcaacctcggaactgcctccaaaactatcagtctggagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcgggcagcatgctgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatggagagatccatggttcccttcggggacgcagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatccccaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttttacctgacgacgctgcgctaaccttcggggggcaggcggccacggtaagatcagcgactggggtgaagtcgtaacaaggtagccgtaggggaacctgcggctggatcacctcctttctaa

SEQ ID NO: 7918 - DNA, 1466 bp, Roseivivax marinus
  ref <308>: DATABASE ACCESSION NUMBER: NCBI ACCESSION: NZ_FOAI01000027.1
  ref <309>: DATABASE ENTRY DATE: 2019-04-01
  ref <313>: RELEVANT RESIDUES IN SEQ ID NO: (1)..(1466)
caacttgagagtttgatcctggctcagaacgaacgctggcggcaggcttaacacatgcaagtcgagcgaagccttcgggcttagcggcggacgggtgagtaacgcgtgggaacgtacccttcggtgcggaataggccctggaaacggggtttaataccgcatacgcccttttggggaaagatttatcgccgaaggatcggcccgcgttggattaggtagttggtggggtaacggcctaccaagccgacgatccatagctggttttagaggatgatcagccacactgggactgagacacggcccagactcctacgggaggcagcagtggggaatcttagacaatgggcgcaagcctgatctagccatgccgcgtgagtgatgaaggtcttaggatcgtaaagctctttcgctggggaagataatgacggtacccagtaaagaaaccccggctaactccgtgccagcagccgcggtaatacggagggggttagcgttgttcggaattactgggcgtaaagcgcgcgtaggcggactggaaagttgggggtgaaatcccggggctcaacctcggaactgcctccaaaactatcagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcggcgcgcatgcgtgtcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctcggatcgtcccagagatgggtctttcacttcggtgaccgagtgacaggtgctgcatggctgtcgtcagctcgtgtcgtgagatgttcggttaagtccggcaacgagcgcaacccacacccttagttgccagcagttcggctgggcactctaggggaactgcccgtgataagcgggaggaaggtgtggatgacgtcaagtcctcatggcccttacgggttgggctacacacgtgctacaatggcggtgacagtgggttaatccccaaaagccgtctcagttcggattgtcctctgcaactcgagggcatgaagtcggaatcgctagtaatcgcggaacagcatgccgcggtgaatacgttcccgggccttgtacacaccgcccgtcacaccatgggagttggttttacctgacgacggtgcgctaaccttcgggaggcagccggccacggtaagatcagcgactggggtgaagtcgtaacaaggtagccgtaggggaacctgcggctggatcacctcctttctaa

SEQ ID NO: 7919 - DNA, 1465 bp, Roseivivax pacificus
  ref <308>: DATABASE ACCESSION NUMBER: NCBI ACCESSION: NZ_QBKN01000065.1
  ref <309>: DATABASE ENTRY DATE: 2019-04-01
  ref <313>: RELEVANT RESIDUES IN SEQ ID NO: (1)..(1465)
caacttgagagtttgatcctggctcagaacgaacgctggcggcaggcttaacacatgcaagtcgagcgaggtcttcggacctagcggcggacgggtgagtaacgcgtgggaacgtgcccttccctgccggatagtccctggaaacggggtttaatacggcatacgcccttcgggggaaagaatttcggggaaggatcggcccgcgtctgattaggtagttggtggggtaatggcctaccaagccgacgatcagtagctggttttagaggatgatcagccacactgggactgagacacggcccagactcctacgggaggcagcagtggggaatcttagacaatgggcgcaagcctgatctagccatgccgcgtgtgtgatgaaggccttagggtcgtaaagcactttcgccagggatgataatgacagtacctggtaaagaaaccccggctaactccgtgccagcagccgcggtaatacggagggggttagcgttgttcggaattactgggcgtaaagcgcgcgtaggcggactggaaagttgggggtgaaatcccggggctcaacctcggaactgccttcaaaactatcagtctagagttcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagacgtcgggcagcatgctgttcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctgggaccgccagagagatctggtttccacttcggtggctcagtgacaggtgctgcatggctgtcgtcagctcgtgtcgtgagatgttcggttaagtccggcaacgagcgcaacccacacccttagttgccagcagttcggctgggcactctaggggaactgcccgtgataagcgggaggaaggtgtggatgacgtcaagtcctcatggcccttacgggttgggctacacacgtgctacaatggcgatgacagtggggtaatcccaaaaagtcgtctcagttcggattgtcctctgcaactcgagggcatgaagtcggaatcgctagtaatcgcggaacagcatgccgcggtgaatacgttcccgggccttgtacacaccgcccgtcacaccatgggagttgggtttacccgaaggcggtgcgccaaccttttggaggcagccgaccacggtaagctcagcgactggggtgaagtcgtaacaaggtagccgtaggggaacctgcggctggatcacctcctttctaa

SEQ ID NO: 7920 - DNA, 1474 bp, Roseivivax roseus
  ref <308>: DATABASE ACCESSION NUMBER: NCBI ACCESSION: NZ_FOGU01000028.1
  ref <309>: DATABASE ENTRY DATE: 2019-04-01
  ref <313>: RELEVANT RESIDUES IN SEQ ID NO: (1)..(1474)
caacttgagagtttgatcctggctcagaacgaacgctggcggcaggcttaacacatgcaagtcgagcgagggcttcggccctagcggcggacgggtgagtaacgcgtgggaacgtacccttcacttcggaatagtccctggaaacggggtttaataccggatgctccctcaggggaaaagatttatcggtgaaggatcggcccgcgtctgattaggtagttggtggggtaacggcctaccaagccgacgatcagtagctggtttgagaggatgatcagccacactgggactgagacacggcccagactcctacgggaggcagcagtggggaatcttagacaatgggcgcaagcctgatctagccatgccgcgtgtgtgacgaaggtcttaggatcgtaaagcactttcgccggggaagataatgacggtacccggtaaagaaaccccggctaactccgtgccagcagccgcggtaatacggagggggttagcgttgttcggaattactgggcgtaaagcgcgcgtaggcggactggaaagttgggggtgaaatcccggggctcaacctcggaactgccctcaaaactatcagtctagagtccgagagaggtgagtggaactccgagtgtagaggtgaaattcgtagatattcggaagaacaccagtggcgaaggcggctcactggctcggtactgacgctgaggtgcgaaagcgtggggagcaaacaggattagataccctggtagtccacgccgtaaacgatgaatgccagacgtcgggcagcatgctgttcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatccctgtcgcggtttccagagatggattccttcagttcggctggacaggagacaggtgctgcatggctgtcgtcagctcgtgtcgtgagatgttcggttaagtccggcaacgagcgcaacccacacccttagttgccagcagttcggctgggcactctaggggaactgcccgtgataagcgggaggaaggtgtggatgacgtcaagtcctcatggcccttacgggttgggctacacacgtgctacaatggcgatgacagtgggttaatcccaaaaagtcgtctcagttcggattgtcctctgcaactcgagggcatgaagtcggaatcgctagtaatcgcggaacagcatgccgcggtgaatacgttcccgggccttgtacacaccgcccgtcacaccatgggagttgggtttacccgaagacggtgcgccgacctgttcgcagggggcagccggccacggtaagctcagcgactggggtgaagtcgtaacaaggtagccgtaggggaacctgcggctggatcacctcctttctaa

SEQ ID NO: 7921 - DNA, 1554 bp, Rosenbergiella nectarea
  ref <308>: DATABASE ACCESSION NUMBER: NCBI ACCESSION: NZ_FOGC01000030.1
  ref <309>: DATABASE ENTRY DATE: 2019-04-01
  ref <313>: RELEVANT RESIDUES IN SEQ ID NO: (1)..(1554)
ttaaattgaagagtttgatcatggctcagattgaacgctggcggcaggcctaacacatgcaagtcgaacggtaacagagagtagcttgctactctgctgacgagtggcggacgggtgagtaatgtctggggatctgcctgatggagggggataactactggaaacggtagctaataccgcataatgtcgcaagaccaaagcgggggactttcgggcctcgcaccatcagatgaacccagatgggattagctagtaggtagggtaatggcttacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagtcaggaggaagggtgtgaaattaatactttcatgcattgacgttactgacagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggctgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttagcagagatgctttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtaaatcagaatgttacggtgaatacgttcccgggccttgtacacaccgcccgtcacaccatgggagtgggttgcaaaagaagtagatagcttaaccttcgggagggcgtttaccactttgtgattcatgactggggtgaagtcgtaacaaggtaaccgtaggggaacctgcggttggatcacctccttacctgtaaga

SEQ ID NO: 7922 - DNA, 1469 bp, Roseobacter denitrificans
  ref <308>: DATABASE ACCESSION NUMBER: NCBI ACCESSION: NZ_FOOO01000001.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgctcacttcggtgggagcggcggacgggttagtaacgcgtgggaacatacccttctctacggaatagcctttggaaacgaagagtaataccgtatacgcccttcgggggaaagatttatcggagatggattggcccgcgttagattagatagttggtggggtaatggcctaccaagtctacgatctatagctggttttagaggacgatcagcaacactgggactgagacacggcccagactcctacgggaggcagcagtggggaatcttagacaatgggcgaaagcctgatctagccatgccgcgtgagtgatgaaggccctagggtcgtaaagctctttcgccagggatgataatgacagtacctggtaaagaaaccccggctaactccgtgccagcagccgcggtaatacggagggggttagcgttgttcggaattactgggcgtaaagcgcacgtaggcggatcagaaagttaggggtgaaatcccgaggctcaacctcggaactgcctctaaaactcctggtcttgagttcgagagaggtgagtggaattccaagtgtagaggtgaaattcgtagatatttggaggaacaccagtggcgaaggcggctcactggctcgatactgacgctgaggtgcgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctaacccgagagatcgggcgttctcgcaagagacgcagtgacaggtgctgcatggctgtcgtcagctcgtgtcgtgagatgttcggttaagtccggcaacgagcgcaacccacatctttagttgccagcagttcggctgggcactctaaagaaactgcccgtgataagcgggaggaaggtgtggatgacgtcaagtcctcatggcccttacgggttgggctacacacgtgctacaatggtagtgaaaatgggttaatccccaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttcggggaggcaggcggccacggtaggatcagcgactggggtgaagtcgtaacaaggtagccgtaggggaacctgcggctggatcacctcctttctaa

SEQ ID NO: 7923 - DNA, 1469 bp, Roseobacter litoralis
  ref <308>: DATABASE ACCESSION NUMBER: NCBI ACCESSION: NC_015730.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgctcacttcggtgggagcggcggacgggttagtaacgcgtgggaacatacccttctctacggaatagcctcgggaaactgagagtaataccgtatacgcccttcgggggaaagatttatcggagatggattggcccgcgttagattagatagttggtggggtaatggcctaccaagtctacgatctatagctggttttagaggacgatcagcaacactgggactgagacacggcccagactcctacgggaggcagcagtggggaatcttagacaatgggcgaaagcctgatctagccatgccgcgtgagtgatgaaggccctagggtcgtaaagctctttcgccagggatgataatgacagtacctggtaaagaaaccccggctaactccgtgccagcagccgcggtaatacggagggggttagcgttgttcggaattactgggcgtaaagcgcacgtaggcggatcagaaagtatagggtgaaatcccagggctcaaccctggaactgccttataaactcctggtcttgagttcgagagaggtgagtggaattccaagtgtagaggtgaaattcgtagatatttggaggaacaccagtggcgaaggcggctcactggctcgatactgacgctgaggtgcgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctaacccgagagatcgggcgttctcgcaagagacgcagtgacaggtgctgcatggctgtcgtcagctcgtgtcgtgagatgttcggttaagtccggcaacgagcgcaacccacatctttagttgccagcagttcggctgggcactctaaagaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttcggggaggcaggcggccacggtaggatcagcgactggggtgaagtcgtaacaaggtagccgtaggggaacctgcggctggatcacctcctttctaa

SEQ ID NO: 7924 - DNA, 1471 bp, Roseobacter sp. AzwK-3b
  ref <308>: DATABASE ACCESSION NUMBER: NCBI ACCESSION: NZ_ABCR01000010.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgaacgagaccttcgggtctagtggcggacgggttagtaacgcgtgggaacgtgcctttcactacggaatagtcccgggaaactgggtttaataccgtatacgcccttcgggggaaagaatttcggtgaaagatcggcccgcgttagattaggtagttggtggggtaatggcctaccaagcctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggattggaaagttgggggtgaaatcccagggctcaaccctggaacggcctccaaaactcccagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggatagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccctgtcgcgggagccggagacggttcctttcagttcggctggacaggtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggcggtgcgccaacctttcgaggaggcagccgaccacggtaagctcagcgactggggtgaagtcgtaacaaggtagccgtaggggaacctgcggctggatcacctcctttctaa

SEQ ID NO: 7925 - DNA, 1469 bp, Roseobacter sp. CCS2
  ref <308>: DATABASE ACCESSION NUMBER: NCBI ACCESSION: NZ_AAYB01000001.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcactcttcggagtgagcggcggacgggttagtaacgcgtgggaacatacccttctctacggaatagcctcgggaaactgagagtaataccgtatacgcccttcgggggaaagatttatcggagatggattggcccgcgttagattagatagttggtggggtaatggcctaccaagtctacgatctatagctggtttgagaggatgatcagcaacactgggactgagacacggcccagactcctacgggaggcagcagtggggaatcttagacaatgggcgaaagcctgatctagccatgccgcgtgagtgacgaaggccttagggtcgtaaagctctttcgccagagatgataatgacagtatctggtaaagaaaccccggctaactccgtgccagcagccgcggtaatacggagggggttagcgttgttcggaattactgggcgtaaagcgtacgtaggcggattggaaagtagggggtgaaatcccagggctcaaccctggaactgcctcctaaactatcagtctagagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagacgtcggggggcttgcccttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccttggaccgctagagagatctagttttctcgtaagagaccaagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcatctacagtgagttaatctccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttcggggaggcaggcggccacggtaggatcagcgactggggtgaagtcgtaacaaggtagccgtaggggaacctgcggctggatcacctcctttctaa

SEQ ID NO: 7926 - DNA, 1471 bp, Roseobacter sp. GAI101
  ref <308>: DATABASE ACCESSION NUMBER: NCBI ACCESSION: NZ_DS999215.1
  ref <309>: DATABASE ENTRY DATE: 2019-04-01
  ref <313>: RELEVANT RESIDUES IN SEQ ID NO: (1)..(1471)
tcaacttgagagtttgatcctggctcagaacgaacgctggcggcaggcctaacacatgcaagtcgagcgcagtccttcgggaccgagcggcggacgggttagtaacgcgtgggaacatacccttttctacggaatagcctcgggaaactgagagtaataccgtataagcccttcgggggaaagatttatcgggaaaggattggcccgcgttagattagatagttggtggggtaatggcctaccaagtctacgatctatagctggttttagaggatgatcagcaacactgggactgagacacggcccagactcctacgggaggcagcagtggggaatcttagacaatgggcgcaagcctgatctagccatgccgcgtgtgtgatgaaggtcttaggatcgtaaagcactttcgccagggatgataatgacagtacctggtaaagaaaccccggctaactccgtgccagcagccgcggtaatacggagggggttagcgttgttcggaattactgggcgtaaagcgtacgtaggcggatcagaaagttaggggtgaaatcccgaggctcaacctcggaactgcctctaaaactcctggtcttgagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctaactcgagagatcgagtgtttatttcggtaacgcagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtgggaatcgctagtaatcgcgtaacagcatgacgcggtgaatacgttcccgggccttgtacacaccgcccgtcacaccatgggagttggttctacccgacgacgctgcgctaacccttcggggaggcaggcggccacggtaggatcagggactggggtgaagtggtaacaaggtagccgtaggggaacctgcggctggatcacctcctttctaa

SEQ ID NO: 7927 - DNA, 1465 bp, Roseobacter sp. MED193
  ref <308>: DATABASE ACCESSION NUMBER: NCBI ACCESSION: NZ_CH902583.1
  ref <309>: DATABASE ENTRY DATE: 2019-04-01
  ref <313>: RELEVANT RESIDUES IN SEQ ID NO: (1)..(1465)
tcaacttgagagtttgatcctggctcagaacgaacgctggcggcaggcttaacacatgcaagtcgagcgcactcttcggagtgagcggcggacgggttagtaacgcgtgggaacgtgcccttttctaaggaatagccactggaaacggtgagtaataccttatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccctagggtcgtaaagctctttcgccagagatgataatgacagtatctggtaaagaaaccccggctaactccgtgccagcagccgcggtaatacggagggggttagcgttgttcggaattactgggcgtaaagcgcacgtaggcggatcagaaagtatgaggtgaaatcccggggctcaaccccggaactgccttgtaaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcagcaagcatgcttgttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggaccgccagagagatctggttttctcgcaagagaccgagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcatcatcaatgggttaatccctaaacgatgtctcagttcggattggggtctgcaactcgaccccatgaagtcggaatcgctagtaatcgcgtaacagcatgacgcggtgaatacgttcccgggccttgtacacaccgcccgtcacaccatgggagttggatctacccgaaggccgtgcgctaacttttgaggcagcggaccacggtgggttcagcgactggggtgaagtcgtaacaaggtagccgtaggggaacctgcggctggatcacctcctttctaa

SEQ ID NO: 7928 - DNA, 1465 bp, Roseobacter sp. SK209-2-6
  ref <308>: DATABASE ACCESSION NUMBER: NCBI ACCESSION: NZ_AAYC01000027.1
  ref <309>: DATABASE ENTRY DATE: 2019-04-01
  ref <313>: RELEVANT RESIDUES IN SEQ ID NO: (1)..(1465)
tcaacttgagagtttgatcctggctcagaacgaacgctggcggcaggcttaacacatgcaagtcgagcgcactcttcggagtgagcggcggacgggttagtaacgcgtgggaacgtgcccttctctaaggaatagccactggaaacggtgagtaataccttatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagagatgataatgacagtatctggtaaagaaaccccggctaactccgtgccagcagccgcggtaatacggagggggttagcgttgttcggaattactgggcgtaaagcgtacgtaggcggatcagaaagtatggggtgaaatcccagggctcaaccctggaactgcctcataaactcctggtcttgagttcgagagaggtgagtggaattccgagtgtagaggtgaaattcgtagatattcggaggaacaccagtggcgaaggcggctcactggctcgatactgacgctgaggtacgaaagtgtggggagcaaacaggattagataccctggtagtccacaccgtaaacgatgaatgccagtcgtcgggtagcatgctgctcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggaccgtcccagagatgggtctttcacttcggtgaccgagtgacaggtgctgcatggctgtcgtcagctcgtgtcgtgagatgttcggttaagtccggcaacgagcgcaacccacgtccttagttgccagcagttcggctgggcactctagggaaactgcccgtgataagcgggaggaaggtgtggatgacgtcaagtcctcatggcccttacgggttgggctacacacgtgctacaatggcatcaacaatgggttaatccctaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgctaacttttgaggcagcggaccacggtgagctcagcgactggggtgaagtcgtaacaaggtagccgtaggggaacctgcggctggatcacctcctttctaa

SEQ ID NO: 7929 - DNA, 328 bp, Roseomonas aerilata
  ref <308>: DATABASE ACCESSION NUMBER: NCBI ACCESSION: NZ_JONP01000031.1
  ref <309>: DATABASE ENTRY DATE: 2019-04-01
  ref <313>: RELEVANT RESIDUES IN SEQ ID NO: (1)..(328)
atgaacttgagagtttgatcctggctcagagcgaacgctggcggcatgcttaacacatgcaagtcgcacggacggtttcggccgttagtggcggacgggggagtaacgcgtaggaacatatccaggggggggggataacgctgggaaactggcgctaataccgcatgtgagctgaggctcaaagcagtgatgcgcctttggagtggcctgcgtccgattagcttgttggtggggtaatggcttaccaaggcgtcgatcggtagctggtctgagaggacgaccagccacactgggactgagacacggcccagactcctacgggaggcag

SEQ ID NO: 7930 - DNA, 1495 bp, Roseomonas aestuarii
  ref <308>: DATABASE ACCESSION NUMBER: NCBI ACCESSION: NZ_PDOA01000055.1
  ref <309>: DATABASE ENTRY DATE: 2019-04-01
  ref <313>: RELEVANT RESIDUES IN SEQ ID NO: (1)..(1495)
atgaacttgagagtttgatcctggctcagagtgaacgctggcggcatgcttaacacatgcaagtcgcacgggcagcaatgtcagtggcggacgggtgagtaacgcgtagggaagtgtccagaggtgggggacaaccccgggaaactggggctaataccgcatatggcctgagggccaaagcagtgatgcgcctttggagttacctgcgtccgattaggtagttggtggggtaaaggcctaccaagccgacgatcggtagctggtctgagaggacgaccagccacactgggactgagacacggcccagactcctacgggaggcagcagtggggaatattggacaatgggcgcaagcctgatccagcaatgccgcgtgggtgaagaaggtcttcggatcgtaaagccctttcggcggggacgatgatgacggtacccgcagaagaagccccggctaacttcgtgccagcagccgcggtaatacgaagggggctagcgttactcggaattactgggcgtaaagggcgcgtaggcggcgttccaagtcaggcgtgaaagccctgggctcaacctggggactgcgcttgatactggagtgcttgaggatggaagagggttgtggaattcccagtgtagaggtgaaattcgtagatattgggaagaacaccggtggcgaaggcggcaacctggtccatttctgacgctgaggcgcgatagcgtggggagcaaacaggattagataccctggtagtccacgccgtaaacgatgtgcgctggatgttgggtgacctagtcactcagtgtcgtagctaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatgggtaggaccgacgcagagatgcgtctttcccgcaagggacctactgcacaggtgctgcatggctgtcgtcagctcgtgtcgtgagatgttgggttaagtcccgcaacgagcgcaaccctcgcctttagttgccagcacgtttgggtgggcactctagaggaactgccggtgacaagccggaggaaggtggggatgacgtcaagtcctcatggcccttatgggctgggctacacacgtgctacaatggcggtgacagtgggaagccaggcagcgatgtcgagccgatcccaaaaagccgtctcagttcagatcgcagcctgcaactcggctgcgtgaaggtggaatcgctagtaatcgcggatcagcacgccgcggtgaatacgttcccgggccttgtacacaccgcccgtcacaccatgggagttggttctaccttaagcaggtgcgcgaacccgcaagggatgtagcttgccacggtagggtcagcgactggggtgaagtcgtaacaaggtagccgtaggggaacctgcggctggatcacctcctttcaag

SEQ ID NO: 7931 - DNA, 1316 bp, Roseomonas cervicalis
  ref <308>: DATABASE ACCESSION NUMBER: NCBI ACCESSION: NZ_GG770779.1
  ref <309>: DATABASE ENTRY DATE: 2019-04-01
  ref <313>: RELEVANT RESIDUES IN SEQ ID NO: (1)..(1316)
aagcagcgatgcgcctttggagtaacctgcgtccgattagctagttggtggggtaaaggcctaccaaggcgacgatcggtagctggtctgagaggacgaccagccacactgggactgagacacggcccagactcctacgggaggcagcagtggggaatattggacaatgggcgcaagcctgatccagcaatgccgcgtgggtgaagaaggtcttcggatcgtaaagccctttcggcggggacgatgatgacggtacccgcagaagaagccccggctaacttcgtgccagcagccgcggtaatacgaagggggctagcgttactcggaattactgggcgtaaagggcgcgtaggcggcgctccaagttaggcgtgaaagccctgggctcaacctggggactgcgcttaagactggagtgctagaggatggaagagggttgtggaattcccagtgtagaggtgaaattcgtagatattgggaagaacaccggtggcgaaggcggcaacctggtccatttctgacgctgaggcgcgatagcgtggggagcaaacaggattagataccctggtagtccacgccgtaaacgatgtgcgctgaatgttggggttcctagaacctcagtgttgtagctaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatggccacgaccggttcagagatgaacttttcccgcaagggacgtggtgcacaggtgctgcatggctgtcgtcagctcgtgtcgtgagatgttgggttaagtcccgcaacgagcgcaaccctcgcctttagttgccagcacgtttgggtgggcactctagaggaactgccggtgacaagccggaggaaggtggggatgacgtcaagtcctcatggcccttatgggctgggctacacacgtgctacaatggcggtgacaatgggaagccaggcagcgatgtcgagccgatcccaaaaagccgtctcagttcagatcgcagcctgcaactcggctgcgtgaaggtggaatcgctagtaatcgcggatcagcacgccgcggtgaatacgttcccgggccttgtacacaccgcccgtcacaccatgggagttggttctaccttaagcaggtgcggtaaccgcaaggagctagcctgccacggtagggtcagtgactggggtgaagtcgtaacaaggtagccgtaggggaacctgcggctggatcacctcctttcaag

SEQ ID NO: 7932 - DNA, 1493 bp, Roseomonas deserti
  ref <308>: DATABASE ACCESSION NUMBER: NCBI ACCESSION: NZ_MLCO01000159.1
  ref <309>: DATABASE ENTRY DATE: 2019-04-01
  ref <313>: RELEVANT RESIDUES IN SEQ ID NO: (1)..(1493)
atgaacttgagagtttgatcctggctcagagtgaacgctggcggcatgcttaacacatgcaagtcgcacgggcagcaatgtcagtggcggacgggtgagtaacgcgtagggaagtgtccagaggtgggggacaaccccgggaaactggggctaataccgcatatggcctgagggccaaagcagtgatgcgcctttggagttacctgcgtccgattagctagttggtggggtaaaggcctaccaaggcgacgatcggtagctggtctgagaggacgaccagccacactgggactgagacacggcccagactcctacgggaggcagcagtggggaatattggacaatgggcgcaagcctgatccagcaatgccgcgtgggtgaagaaggtcttcggatcgtaaagccctttcggcggggacgatgatgacggtacccgcagaagaagccccggctaacttcgtgccagcagccgcggtaatacgaagggggctagcgttactcggaattactgggcgtaaagggcgcgtaggcggcgttccaagttaggcgtgaaagtcctgggctcaacctgggaactgcgcttaagactggagtgctagaggatggaagagggttgtggaattcccagtgtagaggtgaaattcgtagatattgggaagaacaccggtggcgaaggcggcaacctggtccattactgacgctgaggcgcgatagcgtggggagcaaacaggattagataccctggtagtccacgccgtaaacgatgtgcgctggatgttgggtgacctagtcactcagtgtcgtagctaacgcggtaagcgcaccgcctggggagtacggccgcaaggttgaaactcaaaggaattgacgggggcccgcacaagcggtggagcatgtggtttaattcgaagcaacgcgcagaaccttaccagctcttgacatggccacgaccgacgcagagatgcgtttttcccgcaagggacgtggtgcacaggtgctgcatggctgtcgtcagctcgtgtcgtgagatgttgggttaagtcccgcaacgagcgcaaccctcgcctttagttgccagcacgtttgggtgggcactctagaggaactgccggtgacaagccggaggaaggtggggatgacgtcaagtcctcatggcccttatgggctgggctacacacgtgctacaatggcggtgacaatgggaagccaggcagcgatgtcgagccgatcccaaaaagctgtctcagttcagatcgcagcctgcaactcggctgcgtgaaggtggaatcgctagtaatcgcggatcagcacgccgcggtgaatacgttcccgggccttgtacacaccgcccgtcacaccatgggagttggttctaccttaagcaggtgcggtaaccgcaaggagctagcctgccacggtagggtcagtgactggggtgaagtcgtaacaaggtagccgtaggggaacctgcggctggatcacctcctttcaag

SEQ ID NO: 7933 - DNA, 1544 bp, Roseomonas rhizosphaerae
  ref <308>: DATABASE ACCESSION NUMBER: NCBI ACCESSION: NZ_PDNU01000088.1
  ref <309>: DATABASE ENTRY DATE: 2019-04-01
  ref <313>: RELEVANT RESIDUES IN SEQ ID NO: (1)..(1544)
gaactgaagagtttgatcatggctcagattgaacgctggcggcaggcctaacacatgcaagtcgagcggatgaagggagcttgctcctggattcagcggcggacgggtgagtaatgcctaggaatctgcctggtagtgggggataacgtccggaaacgggcgctaataccgcatacgtcctgagggagaaagtgggggatcttcggacctcacgctatcagatgagcctaggtcggattagctagttggtggggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccaacagaataagcaccggctaacttcgtgccagcagccgcggtaatacgaagggtgcaagcgttaatcggaattactgggcgtaaagcgcgcgtaggtggttcagcaagttggatgtgaaatccccgggctcaacctgggaactgcatccaaaactactgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcgactagccgttgggatccttgagatcttagtggcgcagctaacgcgataagtcgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacctcgggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaatgtcacggtgaatacgttcccgggccttgtacacaccgcccgtcacaccatgggagtgggttgctccagaagtagctagtctaaccgcaagggggacggttaccacggagtgattcatgactggggtgaagtcgtaacaaggtagccgtaggggaacctgcggctggatcacctccttaatcgaaga

SEQ ID NO: 7934 - DNA, 1494 bp, Roseomonas rosea
  ref <308>: DATABASE ACCESSION NUMBER: NCBI ACCESSION: NZ_FQZF01000001.1
  ref <309>: DATABASE ENTRY DATE: 2019-04-01
  ref <313>: RELEVANT RESIDUES IN SEQ ID NO: (1)..(1494)
atgaacttgagagtttgatcctggctcagagcgaacgctggcggcatgcttaacacatgcaagtcgcacgggcagcaatgtcagtggcggacgggtgagtaacgcgtaggaacatgtccatgaggtgggggacaaccctgggaaactggggctaataccgcatatcggctgaggccgaaagccttcgggcgcctttggagtggcctgcgttcgattagcttgttggtggggtaatggcctaccaaggctacgatcgatagctggtctgagaggacgaccagccacactgggactgagacacggcccagactcctacgggaggcagcagtggggaatattggacaatgggcgcaagcctgatccagcaatgccgcgtgggtgaagaaggtcttcggattgtaaagccctttcgacagggacgatgatgacggtacctgtagaagaagccccggctaacttcgtgccagcagccgcggtaatacgaagggggctagcgttgctcggaattactgggcgtaaagggcgcgtaggcggcttcattagtcaggcgtgaaaatcctgggcttaacctggggactgcgcttgatacggtgaggcttgaggatggaagaggctcgtggaattcccagtgtagaggtgaaattcgtagatattgggaagaacaccggtggcgaaggcggcgagctggtccattactgacgctgaggcgcgacagcgtggggagcaaacaggattagataccctggtagtccacgccgtaaacgatgtgcgctggatgttgggtggcctagccactcagtgtcgtagccaacgcgataagcgcaccgcctggggagtacggccgcaaggttgaaactcaaaggaattgacgggggcccgcacaagcggtggagcatgtggtttaattcgaagcaacgcgcagaaccttaccagcccttgacatggccacgaccggtccagagatggatctttcccgcaagggacgtggcgcacaggtgctgcatggctgtcgtcagctcgtgtcgtgagatgttgggttaagtcccgcaacgagcgcaaccctcgcctctagttgccagcatgtttgggtgggcactctagaggaactgccggtgacaagccggaggaaggtggggatgacgtcaagtcctcatggcccttatgggctgggctacacacgtgctacaatggcggtgacagagggaagccaggtcgcgaggccgagccgatcccgaaaagccgtctcagttcagattgcaccctgcaactcgggtgcatgaaggtggaatcgctagtaatcgcggatcagcacgccgcggtgaatacgttcccgggccttgtacacaccgcccgtcacaccatgggagttggttctaccttaagtggctgcgctaaccgcaagggggcaggtcaccacggtagggtcagcgactggggtgaagtcgtaacaaggtagccgtaggggaacctgcggctggatcacctcctttcaag

SEQ ID NO: 7935 - DNA, 1496 bp, Roseomonas sp. B5
  ref <308>: DATABASE ACCESSION NUMBER: NCBI ACCESSION: NZ_ALOX01000016.1
  ref <309>: DATABASE ENTRY DATE: 2019-04-01
  ref <313>: RELEVANT RESIDUES IN SEQ ID NO: (1)..(1496)
atgaacttgagagtttgatcctggctcagagcgaacgctggcggcatgcttaacacatgcaagtcgcacgggcagcaatgtcagtggcggacgggtgagtaacgcgtaggaacgtgtcctgaggtgggggacaaccccgggaaactggggctaataccgcatatgggctgaggcccaaagccgagaggcgcctttggagcggcctgcgtccgattaggtagttggtggggtaaaggcctaccaagcctgcgatcggtagctggtctgagaggacgaccagccacactgggactgagacacggcccagactcctacgggaggcagcagtggggaatattggacaatgggcgaaagcctgatccagcaatgccgcgtgggtgaagaaggtcttcggatcgtaaagccctttcgacggggacgatgatgacggtacccgtagaagaagccccggctaacttcgtgccagcagccgcggtaatacgaagggggctagcgttgctcggaattactgggcgtaaagggcgcgtaggcggcggcccaagtcaggcgtgaaattcctgggctcaacctggggactgcgcttgatactgggttgcttgaggatggaagaggctcgtggaattcccagtgtagaggtgaaattcgtagatattgggaagaacaccggtggcgaaggcggcgagctggtccattactgacgctgaggcgcgacagcgtggggagcaaacaggattagataccctggtagtccacgccgtaaacgatgtgcgctggatgttggggcccatagggtctcagtgtcgtagccaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatggtcacgaccggtccagagatggactttcctagcaataggcgtgatgcacaggtgctgcatggctgtcgtcagctcgtgtcgtgagatgttgggttaagtcccgcaacgagcgcaaccctcgcctctagttgccagcatgttcgggtgggcactctagaggaactgccggtgacaagccggaggaaggtggggatgacgtcaagtcctcatggcccttatgggctgggctacacacgtgctacaatggcggtgacagagggaagccaggtcgcgaggccgagccgatcccgaaaagccgtctcagttcggattgcactctgcaactcgggtgcatgaaggtggaatcgctagtaatcgcggatcagcacgccgcggtgaatacgttcccgggccttgtacacaccgcccgtcacaccatgggagttggttctaccttaagtcgttgcgctaaccagcgatgggggcaggcgaccacggtagggtcagcgactggggtgaagtcgtaacaaggtagccgtaggggaacctgcggctggatcacctcctttcaagg

SEQ ID NO: 7936 - DNA, 1493 bp, Roseomonas sp. CPCC 101021
  ref <308>: DATABASE ACCESSION NUMBER: NCBI ACCESSION: NZ_QXGS01000127.1
  ref <309>: DATABASE ENTRY DATE: 2019-04-01
  ref <313>: RELEVANT RESIDUES IN SEQ ID NO: (1)..(1493)
atgaacttgagagtttgatcctggctcagagtgaacgctggcggcatgcttaacacatgcaagtcgcacgggcagcaatgtcagtggcggacgggtgagtaacgcgtagggaagtgtccagaggtgggggacaaccccgggaaactggggctaataccgcatatgtcctgagggacaaagccgtgaggcgcctttggagttacctgcgtccgattaggtagttggtggggtaaaggcctaccaagccgacgatcggtagctggtctgagaggacgaccagccacactgggactgagacacggcccagactcctacgggaggcagcagtggggaatattggacaatgggcgcaagcctgatccagcaatgccgcgtgggtgaagaaggtcttcggatcgtaaagccctttcgacggggacgatgatgacggtacccgtagaagaagccccggctaacttcgtgccagcagccgcggtaatacgaagggggctagcgttactcggaattactgggcgtaaagggcgcgtaggcggcgttccaagttaggcgtgaaagtcctgggctcaacctgggaactgcgcttaagactggagtgcttgaggatggaagaggctcgtggaattcccagtgtagaggtgaaattcgtagatattgggaagaacaccggtggcgaaggcggcgagctggtccattactgacgctgaggcgcgatagcgtggggagcaaacaggattagataccctggtagtccacgccgtaaacgatgtgcgctggatgttgggtgacctagtcactcagtgtcgtagccaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatggtcacgaccggttcagagatgaactttccccgcaaggggcgtgatgcacaggtgctgcatggctgtcgtcagctcgtgtcgtgagatgttgggttaagtcccgcaacgagcgcaaccctcgcctttagttgccagcacgtttgggtgggcactctagaggaactgccggtgacaagccggaggaaggtggggatgacgtcaagtcctcatggcccttatgggctgggctacacacgtgctacaatggcggtgacaacgggatgccaggcagcaatgccgagccgatcccaaaaagccgtctcagttcagatcgcggcctgcaactcggccgcgtgaaggtggaatcgctagtaatcgcggatcagcacgccgcggtgaatacgttcccgggccttgtacacaccgcccgtcacaccatgggagttggttctaccttaagcaggtgcgctaaccgcaagggggtagcttgccacggtagggtcagcgactggggtgaagtcgtaacaaggtagccgtaggggaacctgcggctggatcacctcctttcaag

SEQ ID NO: 7937 - DNA, 1496 bp, Roseomonas sp. CQN31
  ref <308>: DATABASE ACCESSION NUMBER: NCBI ACCESSION: NZ_QGNA01000011.1
  ref <309>: DATABASE ENTRY DATE: 2019-04-01
  ref <313>: RELEVANT RESIDUES IN SEQ ID NO: (1)..(1496)
atgaacctgagagtttgatcctggctcagagcgaacgctggcggcatgcttaacacatgcaagtcgcacggttggggcaacctggcagtggcggacgggtgaggaacacgtaggaacgtatcctggagtgggggataacgctgggaaactggcgctaataccgcatatggcctgagggtcaaagccgagaggcgctttgggagcggcctgcgtccgattagcttgttggtggggtaatggcttaccaaggcgacgatcggtagctggtctgagaggacgaccagccacactgggactgagacacggcccagactcctacgggaggcagcagtggggaatattggacaatgggcgcaagcctgatccagcaatgccgcgtgggtgaagaaggtcttcggattgtaaagccctttcggcggggacgatgatgacggtacccgcagaagaagccccggctaacttcgtgccagcagccgcggtaatacgaagggggctagcgttgctcggaattactgggcgtaaagggcgcgtaggcggccatgtaagtcaggcgtgaaattcctgggctcaacctgggggctgcgcttgagactgtgtggcttgaggacggaagaggctcgtggaattcccagtgtagaggtgaaattcgtagatattgggaagaacaccggtggcgaaggcggcgagctggtccgttactgacgctgaggcgcgacagcgtggggagcaaacaggattagataccctggtagtccacgccgtaaacgatgtgcgctggatgttggggctcttagagcttcagtgtcgtagccaacgcggtaagcgcaccgcctggggagtacggccgcaaggttgaaactcaaaggaattgacgggggcccgcacaagcggtggagcatgtggtttaattcgaagcaacgcgcagaaccttaccagctcttgacatggacaggaccgacccagagatgggtcttccccgcaaggggcttgtcgcacaggtgctgcatggctgtcgtcagctcgtgtcgtgagatgttgggttaagtcccgcaacgagcgcaaccctcgcctccagttgccagcatttggttgggcactctggaggaactgccggtgacaagccggaggaaggtggggatgacgtcaagtcctcatggcccttatgggctgggctacacacgtgctacaatggtggtgacagtgggaagccaggtcgcgaggccgagccgatcccaaaaagccatctcagttcagattgcactctgcaactcgggtgcatgaaggcggaatcgctagtaatcgcgcatcagcatggcgcggtgaatacgttcccgggccttgtacacaccgcccgtcacaccatgggagttggttctaccttaagtggctgcggcaaccgcaaggggctaggtcaccacggtagggtcagcgactggggtgaagtcgtaacaaggtagccgtaggggaacctgcggctggatcacctcctttcaagg

SEQ ID NO: 7938 - DNA, 1496 bp, Roseomonas sp. FDAARGOS 362; identical to SEQ ID NO: 7935
  ref <308>: DATABASE ACCESSION NUMBER: NCBI ACCESSION: NZ_CP024588.1
  ref <309>: DATABASE ENTRY DATE: 2019-04-01
  ref <313>: RELEVANT RESIDUES IN SEQ ID NO: (1)..(1496)

SEQ ID NO: 7939 - DNA, 1496 bp, Roseomonas sp. TAS13; identical to SEQ ID NO: 7935
  ref <308>: DATABASE ACCESSION NUMBER: NCBI ACCESSION: NZ_BDLP01000288.1
  ref <309>: DATABASE ENTRY DATE: 2019-04-01
  ref <313>: RELEVANT RESIDUES IN SEQ ID NO: (1)..(1496)

SEQ ID NO: 7940 - DNA, 1493 bp, Roseomonas sp. Z23
  ref <308>: DATABASE ACCESSION NUMBER: NCBI ACCESSION: NZ_RFLX01000133.1
  ref <309>: DATABASE ENTRY DATE: 2019-04-01
  ref <313>: RELEVANT RESIDUES IN SEQ ID NO: (1)..(1493)
atgaacttgagagtttgatcctggctcagagtgaacgctggcggcatgcttaacacatgcaagtcgcacgggcagcaatgtcagtggcggacgggtgagtaccgcgtaggaatgtgtccagaggtgggggacaaccttgggaaactgaggctaataccgcatatgagctgaggctcaaagccgcgaggcgcctttggagtagcctgcgtccgattagctagttggtggggtaaaggcctaccaaggcgacgatcggtagctggtctgagaggacgaccagccacactgggactgagacacggcccagactcctacgggaggcagcagtggggaatattggacaatgggcgcaagcctgatccagcaatgccgcgtgggtgaagaaggtcttcggatcgtaaagccctttcggcggggacgatgatgacggtacccgcagaagaagccccggctaacttcgtgccagcagccgcggtaatacgaagggggctagcgttactcggaattactgggcgtaaagggcgcgtaggcggcgcaccaagttaggcgtgaaagtcctgggctcaacctgggaactgcgcttgatactggtgtgcttgaggatggaagagggttgtggaattcccagtgtagaggtgaaattcgtagatattgggaagaacaccggtggcgaaggcggcaacctggtccattactgacgctgaggcgcgacagcgtggggagcaaacaggattagataccctggtagtccacgccgtaaacgatgtgcgctggatgttgggtgacctagtcactcagtgtcgtagctaacgcgataagcgcaccgcctggggagtacggccgcaaggttgaaactcaaaggaattgacgggggcccgcacaagcggtggagcatgtggtttaattcgaagcaacgcgcagaaccttaccagcccttgacatggtcaggaccggcgcagagatgcgctttccccgcaaggggcctgatgcacaggtgctgcatggctgtcgtcagctcgtgtcgtgagatgttgggttaagtcccgcaacgagcgcaaccctcgcctttagttgccagcatgtttgggtgggcactctaaaggaactgccggtgacaagccggaggaaggtggggatgacgtcaagtcctcatggcccttatgggctgggctacacacgtgctacaatggcggtgacaatgggaagccagtcagcaatggcgagccgatcccaaaaagccgtctcagttcagatcgcggcctgcaactcggccgcgtgaaggtggaatcgctagtaatcgcggatcagcacgccgcggtgaatacgttcccgggccttgtacacaccgcccgtcacaccatgggagttggttttaccttaagtcggtgcggtaaccgcaaggagctagccgaccacggtaggatcagtgactggggtgaagtcgtaacaaggtagccgtaggggaacctgcggctggatcacctcctttcaag

SEQ ID NO: 7941 - DNA, 1493 bp, Roseomonas sp. Z24; identical to SEQ ID NO: 7940
  ref <308>: DATABASE ACCESSION NUMBER: NCBI ACCESSION: NZ_RAQU01000427.1
  ref <309>: DATABASE ENTRY DATE: 2019-04-01
  ref <313>: RELEVANT RESIDUES IN SEQ ID NO: (1)..(1493)

SEQ ID NO: 7942 - DNA, 1500 bp, Roseospirillum parvum
  ref <308>: DATABASE ACCESSION NUMBER: NCBI ACCESSION: NZ_FNCV01000025.1
  ref <309>: DATABASE ENTRY DATE: 2019-04-01
  ref <313>: RELEVANT RESIDUES IN SEQ ID NO: (1)..(1500)
ggtcaacttgagagtttgatcctggctcaggacgaacgctggcggcaggcctaacacatgcaagtcgaacgcactcttcggagtgagtggcgcacgggtgagtaacgcgtgggaacgtacccttcggtgcggaataaccactggaaacggtggctaataccgcatacgcccctcgggggaaagatttatcgccgaaggatcggcccgcgttggattaggtagttggtgtggtaatggcgcaccaagccgacgatccatagctggtctgagaggatgatcagccacactgggactgagacacggcccagactcctacgggaggcagcagtggggaatattggacaatgggggcaaccctgatccagccatgccgcgtgggtgaagaaggccttcgggttgtaaagccctttcaggtgggaagatgatgacggtaccaccagaagaagccccggctaacttcgtgccagcagccgcggtaatacgaagggggctagcgttgttcggaattactgggcgtaaagcgcgcgtaggcggaaacgtcagtcagaggtgaaagcccagggctcaaccttggaactgcctttgatactgcgtttcttgagtccggaagagggcggtggaatacccagtgtagaggtgaaattcgtagatattgggtggaacaccagtggcgaaggcggccgcctggtccggtactgacgctgaggtgcgaaagcgtggggagcaaacaggattagataccctggtagtccacgccgtaaacgatgagtgctagttgttgggcagcttgctgttcagtgacgcagctaacgcgttaagcactccgcctggggagtacggccgcaaggttaaaactcaaaggaattgacgggggcccgcacaagcggtggagcatgtggtttaattcgaagcaacgcgcagaaccttaccaacccttgacatgggggtcgcggataccggagacggtttccttcagttcggctggaccccacacaggtgctgcatggctgtcgtcagctcgtgtcgtgagatgttgggttaagtcccgcaacgagcgcaaccctcgcccttagttgccatcattcagttgggcactctaagggaactgccggtgacaagccggaggaaggtggggatgacgtcaagtcctcatggcccttacgggttgggctacacacgtgctacaatggcgtctacagtgggcagcgatggggcgaccctgagctaatctccaaaagacgtctcagttcggattgtactctgcaactcgagtgcatgaagtcggaatcgctagtaatcgcggatcagcatgccgcggtgaatacgttcccgggccttgtacacaccgcccgtcacaccatgggagttggttctacccgaagacggtgcgctaacccgcaagggaggcagccggccacggtagggtcagcgactggggtgaagtcgtaacaaggtagccgtaggggaacctgcggctggatcacctcctttcaaggacgc

SEQ ID NO: 7943 - DNA, 1470 bp, Roseovarius aestuarii
  ref <308>: DATABASE ACCESSION NUMBER: NCBI ACCESSION: NZ_FWXB01000015.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcaggcctaacacatgcaagtcgagcgcaccttcgggtgagcggcggacgggttagtaacgcgtgggaacgtacccttttctacggaatagccattggaaacgatgagtaataccgtatacgcccttcgggggaaagatttatcggagaaggatcggcccgcgttagattagatagttggtggggtaatggcctaccaagtctacgatctatagctggttttagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgtacgtaggcggattagaaagttaggggtgaaatcccagggctcaaccctggaactgcctctaaaactactagtctagagttcgagagaggtgagtggaactccgagtgtagaggtgaaattcgtagatattcggaagaacaccagtggcgaaggcggctcactggctcgatactgacgctgaggtacgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttaccggagacggtttccttcagttcggctggatcagtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgccaacctttcgagggggcagcggaccacggtgagctcagcgactggggtgaagtcgtaacaaggtagccgtaggggaacctgcggctggatcacctcctttctaa

SEQ ID NO: 7944 - DNA, 1471 bp, Roseovarius albus
  ref <308>: DATABASE ACCESSION NUMBER: NCBI ACCESSION: NZ_FWFX01000029.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgcgcccttcggggtgagcggcggacgggttagtaacgcgtgggaacgtacccagatctacggaatagcctttggaaacgaagagtaataccgtatacgcccttcgggggaaagatttatcggatttggatcggcccgcgttagattagatagttggtggggtaatggcctaccaagtctacgatctatagctggttttagaggatgatcagcaacactgggactgagacacggcccagactcctacgggaggcagcagtggggaatcttagacaatgggcgcaagcctgatctagccatgccgcgtgagtgatgaaggccctagggtcgtaaagctctttcgccagagatgataatgacagtatctggtaaagaaaccccggctaactccgtgccagcagccgcggtaatacggagggggttagcgttgttcggaattactgggcgtaaagcgcgcgtaggcggaccagaaagttgggggtgaaatcccggggctcaaccccggaactgcctccaaaactcctgatctagagttcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagtcgtcgggtagtatactattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggatactggagacagtttccttcatttagttggatcagtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgccaacctttcgagggggcagcggaccacggtgagctcagcgactggggtgaagtcgtaacaaggtagccgtaggggaacctgcggctggatcacctcctttctaa

SEQ ID NO: 7945 - DNA, 1473 bp, Roseovarius atlanticus
  ref <308>: DATABASE ACCESSION NUMBER: NCBI ACCESSION: NZ_LAXJ01000009.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcaggcctaacacatgcaagtcgagcgagaacttcggttctagcggcggacgggttagtaacgcgtgggaacgtgcccttcactacggaatagtcccgggaaactgggtttaataccgtatacgcccttcgggggaaagaatttcggtgaaggatcggcccgcgttagattagatagttggtggggtaatggcctaccaagtctacgatctatagctggttttagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggattagaaagttgggggtgaaatcccagggctcaaccctggaactgcctccaaaactactagtctagagttcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagtcgtcggcgcgcatgcgtgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggtttctcgagagagattccttcagttcggctggatcagtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggtggtaacagagggttaatccctaaaaaccatctcagttcggattgttctctgcaactcgagagcatgaagtcggaatcgctagtaatcgcgtaacagcatgacgcggtgaatacgttcccgggccttgtacacaccgcccgtcacaccatgggagttgggtttacccgaagacggtgcgccaacctgttcgcagggggcagctggccacggtaagctcagcgactggggtgaagtcgtaacaaggtagccgtaggggaacctgcggctggatcacctcctttctaa

SEQ ID NO: 7946 - DNA, 1473 bp, Roseovarius confluentis
  ref <308>: DATABASE ACCESSION NUMBER: NCBI ACCESSION: NZ_PPFE01000006.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcaggcctaacacatgcaagtcgagcgagaacttcggttctagcggcggacgggttagtaacgcgtgggaacgtgcccttcactacggaatagtcccgggaaactgggtttaataccgtatacgcccttcgggggaaagaatttcggtgaaggatcggcccgcgttagattagatagttggtggggtaacggcctaccaagtctacgatctatagctggttttagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggattggaaagttgggggtgaaatcccagggctcaaccctggaactgcctccaaaactatcagtctagagttcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagtcgtcggatagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggtttctcgagagagattccttcagttcggctggatcagtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggtggtaacagagggttaatccctaaaaaccatctcagttcggattgtcgtctgcaactcgacggcatgaagtcggaatcgctagtaatcgcgtaacagcatgacgcggtgaatacgttcccgggccttgtacacaccgcccgtcacaccatgggagttgggtttacccgaagacggtgcgccgacctgttcgcagggggcagctggccacggtaagctcagcgactggggtgaagtcgtaacaaggtagccgtaggggaacctgcggctggatcacctcctttctaa

SEQ ID NO: 7947 - DNA, 1473 bp, Roseovarius gaetbuli
  ref <308>: DATABASE ACCESSION NUMBER: NCBI ACCESSION: NZ_FWFJ01000095.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcaggcctaacacatgcaagtcgagcgagaccttcgggtctagcggcggacgggttagtaacgcgtgggaacgtacccttctctaaggaatagccactggaaacggtgagtaataccttatacgcccttcgggggaaagatttatcggagaaggatcggcccgcgtaagattagatagttggtggggtaatggcctaccaagtctacgatctttagctggttttagaggatgatcagcaacactgggactgagacacggcccagactcctacgggaggcagcagtggggaatcttagacaatgggcgcaagcctgatctagccatgccgcgtgtgtgacgaaggccttagggtcgtaaagcactttcgcctgtgatgataatgacagtagcaggtaaagaaaccccggctaactccgtgccagcagccgcggtaatacggagggggttagcgttgttcggaattactgggcgtaaagcgcacgtaggcggattggaaagtatggggtgaaatcccagggctcaaccctggaactgcctcataaacttccagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatactcatcgtcgctccagagatggagctttcagttcggctggatgagatacaggtgctgcatggctgtcgtcagctcgtgtcgtgagatgttcggttaagtccggcaacgagcgcaacccacatccctagttgccagcaggttaagctgggcactctatggaaactgcccgtgataagcgggaggaaggtgtggatgacgtcaagtcctcatggcccttacgggttgggctacacacgtgctacaatggtggtgacaatgggttaatcccaaaaagccatctcagttcggattggggtctgcaactcgaccccatgaagtcggaatcgctagtaatcgcgtaacagcatgacgcggtgaatacgttcccgggccttgtacacaccgcccgtcacaccatgggagttggatctacccgaaggccgtgcgccaacctcttcggagggggcagcggaccacggtgggttcagcgactggggtgaagtcgtaacaaggtagccgtaggggaacctgcggctggatcacctcctttctaa

SEQ ID NO: 7948 - DNA, 1471 bp, Roseovarius halotolerans
  ref <308>: DATABASE ACCESSION NUMBER: NCBI ACCESSION: NZ_FWFU01000002.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgaacgagaccttcgggtctagtggcggacgggttagtaacgcgtgggaacgtgcctttcactacggaatagtcccgggaaactgggtttaataccgtatacgcccttcgggggaaagaatttcggtgaaagatcggcccgcgttagattaggtagttggtggggtaatggcctaccaagcctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcacgtaggcggattggaaagttgggggtgaaatcccagggctcaaccctggaactgcctccaaaactaccagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggatagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttacgagagatcgtttccttcagttcggctggatcagtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggcggtgcgccaacctttcgagggggcagccgaccacggtaagctcagcgactggggtgaagtcgtaacaaggtagccgtaggggaacctgcggctggatcacctcctttctaa

SEQ ID NO: 7949 - DNA, 1471 bp, Roseovarius indicus
  ref <308>: DATABASE ACCESSION NUMBER: NCBI ACCESSION: NZ_FOMY01000016.1
  ref <309>: DATABASE ENTRY DATE: 2019-04-01
  ref <313>: RELEVANT RESIDUES IN SEQ ID NO: (1)..(1471)
caacttgagagtttgattctggctcagaacgaacgctggcggcaggcttaacacatgcaagtcgaacgagatcttcggatctagtggcggacgggtgagtaacgcgtgggaacatgcccttcactacggaatagtcccgggaaactgggtttaataccgtatacgcccttcgggggaaagaatttcggtgaaggattggcccgcgttagattaggtagttggtggggtaatggcctaccaagcctacgatctatagctggttttagaggatgatcagccacactgggactgagacacggcccagactcctacgggaggcagcagtggggaatcttagacaatgggcgaaagcctgatctagccatgccgcgtgagtgacgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggattggaaagttgggggtgaaatcccagggctcaaccctggaactgcctccaaaactactagtctagagttcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagtcgtcggatagcatgctattcggtgacacacctaacggattaagcattccgcctggggagtacggccgcaaggttaaaactcaaagaaattgacgggggcccgcacaagcggtggagcatgtggtttaattcgaagcaacgcgcagaaccttaccaacccttgacatcctgatcgcggttacgagagatcgtttccttcagttcggctggatcagtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggtggtgacagtgggttaatccccaaaagccatctcagttcggattgtcgtctgcaactcgacggcatgaagtcggaatcgctagtaatcgcgtaacagcatgacgcggtgaatacgttcccgggccttgtacacaccgcccgtcacaccatgggagttgggtttacccgaagacggtgcgccaacctttatagggggcagctggccacggtaagctcagcgactggggtgaagtcgtaacaaggtagccgtaggggaacctgcggctggatcacctcctttctaa

SEQ ID NO: 7950 - DNA, 1473 bp, Roseovarius marisflavi; identical to SEQ ID NO: 7947
  ref <308>: DATABASE ACCESSION NUMBER: NCBI ACCESSION: NZ_FRBN01000026.1
  ref <309>: DATABASE ENTRY DATE: 2019-04-01
  ref <313>: RELEVANT RESIDUES IN SEQ ID NO: (1)..(1473)

SEQ ID NO: 7951 - DNA, 1471 bp, Roseovarius nanhaiticus
  ref <308>: DATABASE ACCESSION NUMBER: NCBI ACCESSION: NZ_FTNV01000011.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcttaacacatgcaagtcgagcgcaccttcgggtgagcggcggacgggttagtaacgcgtgggaacgtgcccttctctacggaatagtctcgggaaactgagggtaataccgtatacgcccttcgggggaaagatttatcggagaaggatcggcccgcgttagattagatagttggtggggtaatggcctaccaagtctacgatctatagctggttttagaggatgatcagcaacactgggactgagacacggcccagactcctacgggaggcagcagtggggaatcttagacaatgggcgcaagcctgatctagccatgccgcgtgagtgatgaaggtcttaggatcgtaaagctctttcgccagggatgataatgacagtacctggtaaagaaaccccggctaactccgtgccagcagccgcggtaatacggagggggttagcgttgttcggaattactgggcgtaaagcgcgcgtaggcggattagaaagtatggggtgaaatcccagggctcaaccctggaactgcctcataaactactagtctagagttcgagagaggtgagtggaattgtgagtgtagaggtgaaattcgtagatattcacaggaacaccagtggcgaaggcggctcactggctcgatactgacgctgaggtgcgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggacatcatactttcgagagatcgatcggtcagttcggctggatgtcacacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggcagtgacaatgggttaatccccaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttgggcctacccgacggccgtgcgctaacctcttcggaggaggcagcggaccacggtaagctcagcgactggggtgaagtcgtaacaaggtagccgtaggggaacctgcggctggatcacctcctttctaa

SEQ ID NO: 7952 - DNA, 1473 bp, Roseovarius nitratireducens
  ref <308>: DATABASE ACCESSION NUMBER: NCBI ACCESSION: NZ_PDNI01000030.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcaggcttaacacatgcaagtcgagcgcgcccttcggggtgagcggcggacgggtgagtaacgcgtgggaacgtgccctcttctgcgggatagcctctggaaacggagagtaataccgcatacgcccttttggggaaagatttatcggaggaggatcggcccgcgttggattaggtagttggtggggtaatggcctaccaagccgacgatccatagctggttttagaggatgatcagccacactgggactgagacacggcccagactcctacgggaggcagcagtggggaatcttagacaatgggcgcaagcctgatctagccatgccgcgtgagtgacgaaggtcttaggatcgtaaagctctttcgcctgtgaagataatgacggtagcaggtaaagaaaccccggctaactccgtgccagcagccgcggtaatacggagggggttagcgttgttcggaattactgggcgtaaagcgcacgtaggcggatcagaaagttgggggtgaaatcccggggctcaaccccggaactgcctccaaaacttctggtctggagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctgatcgcggttaccggagacggtttccttcagttcggctggatcagtgacaggtgctgcatggctgtcgtcagctcgtgtcgtgagatgttcggttaagtccggcaacgagcgcaacccacatccccagttgccagcaggttatgctgggcactctgtggaaactgcccgtgataagcgggaggaaggtgtggatgacgtcaagtcctcatggcccttacgggttgggctacacacgtgctacaatggtggtgacaatgggttaatccccaaaagccatctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgacggccgtgcgctaacccttcggggaggcagcggaccacggtaagctcagcgactggggtgaagtcgtaacaaggtagccgtaggggaacctgcggctggatcacctcctttctaa

SEQ ID NO: 7953 - DNA, 1470 bp, Roseovarius nubinhibens
  ref <308>: DATABASE ACCESSION NUMBER: NCBI ACCESSION: NZ_CH724156.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcaggcctaacacatgcaagtcgagcgcaccttcgggtgagcggcggacgggttagtaacgcgtgggaacgtacccagatctaaggaatagccactggaaacggtgagtaataccttatacgcccttcgggggaaagatttatcggatttggatcggcccgcgttagattaggtagttggtggggtaatggcctaccaagcctacgatctatagctggttttagaggatgatcagcaacactgggactgagacacggcccagactcctacgggaggcagcagtggggaatcttagacaatgggggcaaccctgatctagccatgccgcgtgagtgaagaaggtcttaggatcgtaaagctctttcgccagggatgataatgacagtacctggtaaagaaaccccggctaactccgtgccagcagccgcggtaatacggagggggttagcgttgttcggaattactgggcgtaaagcgcgcgtaggcggatcagaaagttgggggtgaaatcccagggctcaaccctggaactgcctccaaaactcctggtcttgagttcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagtcgtcgggtagtatactattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggatcgtagagatactttccttcagttcggctggatcagtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgccaacctttcgagggggcagcggaccacggtgagctcagcgactggggtgaagtcgtaacaaggtagccgtaggggaacctgcggctggatcacctcctttctaa

SEQ ID NO: 7954 - DNA, 1471 bp, Roseovarius pacificus
  ref <308>: DATABASE ACCESSION NUMBER: NCBI ACCESSION: NZ_FRBR01000035.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgaacgaagccttcgggcttagtggcggacgggttagtaacgcgtgggaacgtgcctttcactacggaatagtcccgggaaactgggtttaataccgtatacgcccttcgggggaaagaatttcggtgaaagatcggcccgcgttagattaggtagttggtggggtaatggcctaccaagcctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggatcggaaagttgggggtgaaatcccggggctcaaccccggaactgcctccaaaactatcggtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttacgagagatcgtttccttcagttcggctggatcagtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggcagtgacaatgggttaatccccaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggcggtgcgccaacctttcgagggggcagccgaccacggtaagctcagcgactggggtgaagtcgtaacaaggtagccgtaggggaacctgcggctggatcgcctcctttctaa

SEQ ID NO: 7955 - DNA, 1472 bp, Roseovarius salinarum
  ref <308>: DATABASE ACCESSION NUMBER: NCBI ACCESSION: NZ_PHNT01000012.1
  ref <309>: DATABASE ENTRY DATE: 2019-04-01
  ref <313>: RELEVANT RESIDUES IN SEQ ID NO: (1)..(1472)
caacttgagagtttgatcctggctcagaacgaacgctggcggcaggcctaacacatgcaagtcgagcgatccttcgggatagcggcggacgggtgagtaacgcgtggggatgtgcccagaggtacggaatagcccagggaaacttggattaataccgtatacgcccttcgggggaaagatttatcgcctttggatcaacccgcgtctgattaggtagttggtggggtaatggcctaccaagcctacgatcagtagctggttttagaggatgatcagccacactgggactgagacacggcccagactcctacgggaggcagcagtggggaatcttagacaatgggggaaaccctgatctagccatgccgcgtgagtgacgaaggccctagggtcgtaaagctctttcgccagggatgataatgacagtacctggtaaagaaaccccggctaactccgtgccagcagccgcggtaatacggagggggttagcgttgttcggaattactgggcgtaaagcgcacgtaggcggatcggaaagttgggggtgaaatcccggggctcaaccccggaactgcctccaaaactatcggtctagagttcgagagaggtgagtggaattccgagtgtagaggtgaaattcgtagatattcggaagaacaccagtggcgaaggcggctcactggctcgatactgacgctgaggtgcgaaagcgtgggtagcaaacaggattagataccctggtagtccacgccgtaaacgttgaatgccagtcgtcgggcagcatgctgttcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctggtcgcggtttccggagacggattccttcagttcggctggaccagtgacaggtgctgcatggctgtcgtcagctcgtgtcgtgagatgttcggttaagtccggcaacgagcgcaacccacatccccagttgccagcagttcggctgggcactctgtggaaactgcccgtgataagcgggaggaaggtgtggatgacgtcaagtcctcatggcccttacgggttgggctacacacgtgctacaatggtggtgacagagggttaatcccgaaaaaccatctcagttcggattggggtctgcaactcgactccatgaagtcggaatcgctagtaatcgtggaacagcatgccacggtgaatacgttcccgggccttgtacacaccgcccgtcacaccatgggagttgggtttacccgaagacggtgcgccaacctgttttcaggaggcagccggccacggtaagctcagcgactggggtgaagtcgtaacaaggtagccgtaggggaacctgcggctggatcacctcctttctaa

SEQ ID NO: 7956 - DNA, 1474 bp, Roseovarius sp. 217
  ref <308>: DATABASE ACCESSION NUMBER: NCBI ACCESSION: NZ_CH902584.1
  ref <309>: DATABASE ENTRY DATE: 2019-04-01
  ref <313>: RELEVANT RESIDUES IN SEQ ID NO: (1)..(1474)
caacttgagagtttgatcctggctcagaacgaacgctggcggcaggcctaacacatgcaagtcgagcgagatcttcggatctagcggcggacgggtgagtaacgcgtgggaacgtaccctcttctgcgggatagccactggaaacggtgagtaataccgcatacgcccttcgggggaaagatttatcggaggaggatcggcccgcgttggattaggtagttggtggggtaatggcctaccaagcctacgatccatagctggttttagaggatgatcagccacactgggactgagacacggcccagactcctacgggaggcagcagtggggaatcttagacaatgggcgcaagcctgatctagccatgccgcgtgagtgacgaaggccttagggtcgtaaagctctttcgcctgtgatgataatgacagtagcaggtaaagaaaccccggctaactccgtgccagcagccgcggtaatacggagggggttagcgttgttcggaattactgggcgtaaagcgcacgtaggcggattggaaagtatggggtgaaatcccagggctcaaccctggaacggcctcataaacttccagtctggagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatagatatcgtagttaccagagatggtttcgtcagttcggctggatatcatacaggtgctgcatggctgtcgtcagctcgtgtcgtgagatgttcggttaagtccggcaacgagcgcaacccacatccctagttgccagcaggttaagctgggcactctatggaaactgcccgtgataagcgggaggaaggtgtggatgacgtcaagtcctcatggcccttacgggttgggctacacacgtgctacaatggtggtgacaatgggttaatcccaaaaagccatctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgacgacggtgcgctaacctcgcaagaggaggcagccggccacggtaggctcagcgactggggtgaagtcgtaacaaggtagccgtaggggaacctgcggctggatcacctcctttctaa

SEQ ID NO: 7957 - DNA, 1473 bp, Roseovarius sp. 22II1-1F6A
  ref <308>: DATABASE ACCESSION NUMBER: NCBI ACCESSION: NZ_AQQQ01000036.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcaggcctaacacatgcaagtcgagcgagatcttcggatctagcggcggacgggttagtaacgcgtgggaacgtgcccttcactacggaatagtcccgggaaactgggtttaataccgtatacgcccttcgggggaaagatttatcggtgaaggatcggcccgcgtctgattagatagttggtggggtaatggcctaccaagtctacgatcagtagctggtttgagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcgcctgtgaagataatgacggtagcaggtaaagaaaccccggctaactccgtgccagcagccgcggtaatacggagggggttagcgttgttcggaattactgggcgtaaagcgcacgtaggcggactaataagtcagaggtgaaatcccagggctcaaccttggaactgcctttgatactgttagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttacgagagatcgtttccttcatttagttggatcagtgacaggtgctgcatggctgtcgtcagctcgtgtcgtgagatgttcggttaagtccggcaacgagcgcaacccacacctttagttgccagcagttcggctgggcactctaaaggaactgcccgtgataagcgggaggaaggtgtggatgacgtcaagtcctcatggcccttacgggttgggctacacacgtgctacaatggcagtgacaatgggttaatccccaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgaaggtggtgcgccaacctgttcgcaggaggcagccaaccacggtaggatcagcgactggggtgaagtcgtaacaaggtagccgtaggggaacctgcggctggatcacctcctttctaa

SEQ ID NO: 7958 - DNA, 1474 bp, Roseovarius sp. A-2
  ref <308>: DATABASE ACCESSION NUMBER: NCBI ACCESSION: NZ_BDIY01000053.1
  ref <309>: DATABASE ENTRY DATE: 2019-04-01
  ref <313>: RELEVANT RESIDUES IN SEQ ID NO: (1)..(1474)
caacttgagagtttgatcctggctcagaacgaacgctggcggcaggcctaacacatgcaagtcgagcgaacccttcggggttagcggcggacgggtgagtaacgcgtgggaacgtaccctcttctgcggaatagccactggaaacggtgagtaataccgcatacgcccttcgggggaaagatttatcggaggaggatcggcccgcgttggattaggtagttggtggggtaatggcctaccaagcctacgatccatagctggttttagaggatgatcagccacactgggactgagacacggcccagactcctacgggaggcagcagtggggaatcttagacaatgggcgcaagcctgatctagccatgccgcgtgagtgacgaaggccttagggtcgtaaagctctttcgcctgtgatgataatgacagtagcaggtaaagaaaccccggctaactccgtgccagcagccgcggtaatacggagggggttagcgttgttcggaattactgggcgtaaagcgcacgtaggcggatcagaaagttgggggtgaaatcccggggctcaaccccggaactgcctccaaaacttctggtctggagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggatatcgtagttaccagagatggtttcgtcagttcggctggatatcacacaggtgctgcatggctgtcgtcagctcgtgtcgtgagatgttcggttaagtccggcaacgagcgcaacccacatccctagttgccagcaggttaagctgggcactctatggaaactgcccgtgataagcgggaggaaggtgtggatgacgtcaagtcctcatggcccttacgggttgggctacacacgtgctacaatggtggtgacaatgggttaatccccaaaaaccatctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgacggccgtgcgctaacctcttcggaggaggcagcggaccacggtaagctcagcgactggggtgaagtcgtaacaaggtagccgtaggggaacctgcggctggatcacctcctttctaa

SEQ ID NO: 7959 - DNA, 1473 bp, Roseovarius sp. A46; identical to SEQ ID NO: 7952
  ref <308>: DATABASE ACCESSION NUMBER: NCBI ACCESSION: NZ_PVWS01000061.1
  ref <309>: DATABASE ENTRY DATE: 2019-04-01
  ref <313>: RELEVANT RESIDUES IN SEQ ID NO: (1)..(1473)

SEQ ID NO: 7960 - DNA, 219 bp, Roseovarius sp. EL26
  ref <308>: DATABASE ACCESSION NUMBER: NCBI ACCESSION: NZ_OUMZ01000006.1
  ref <309>: DATABASE ENTRY DATE: 2019-04-01
  ref <313>: RELEVANT RESIDUES IN SEQ ID NO: (1)..(219)
tcaacttgagagtttgatcctggctcagaacgaacgctggcggcaggcctaacacatgcaagtcgagcgcgcccttcggggtgagcggcggacgggttagtaacgcgtgggaatgtacccttctctacggaatagcctttggaaacgaagagtaataccgtatacgcccttcgggggaaagatttatcggagaaggatcagcccgcgttagattagata

SEQ ID NO: 7961 - DNA, 1472 bp, Roseovarius sp. GCL-8
  ref <308>: DATABASE ACCESSION NUMBER: NCBI ACCESSION: NZ_QITQ01000005.1
  ref <309>: DATABASE ENTRY DATE: 2019-04-01
  ref <313>: RELEVANT RESIDUES IN SEQ ID NO: (1)..(1472)
caacctgagagtttgattctggctcagaacgaacgctggcggcaggcttaacacatgcaagtcgaacgagatcttcggatctagtggcggacgggtgagtaacgcgtgggaacgtgcctttcactacggaatagtcctgggaaactgggtttaataccgtatacgcccttcgggggaaagaatttcggtgaaagatcggcccgcgttggattaggtagttggtggggtaatggcctaccaagccgacgatccatagctggttttagaggatgatcagccacactgggactgagacacggcccagactcctacgggaggcagcagtggggaatcttagacaatgggggaaaccctgatctagccatgccgcgtgagtgacgaaggccctagggtcgtaaagctctttcaacggtgaagataatgacggtagccgtagaagaaaccccggctaactccgtgccagcagccgcggtaatacggagggggttagcgttgttcggaattactgggcgtaaagcgcgcgtaggcggattggaaagttgggggtgaaatcccggggctcaaccccggaactgcctccaaaactatcagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggccgcaaggttaaaactcaaagaaattgacgggggcccgcacaagcggtggagcatgtggtttaattcgaagcaacgcgcagaaccttaccaacccttgacatccctgtcgcgggtaccggagacggtatccttcagttcggctggacaggtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggtggtgacagtgggttaatccccaaaaaccatctcagttcggattgtcgtctgcaactcgacggcatgaagtcggaatcgctagtaatcgcgtaacagcatgacgcggtgaatacgttcccgggccttgtacacaccgcccgtcacaccatgggagttgggttcacccgaaggccgtgcgccaacctgtttacagggggcagcggaccacggtgagctcagcgactggggtgaagtcgtaacaaggtagccgtaggggaacctgcggctggatcacctcctttcta

SEQ ID NO: 7962 - DNA, 1471 bp, Roseovarius sp. HN-E21
  ref <308>: DATABASE ACCESSION NUMBER: NCBI ACCESSION: NZ_RAPE01000004.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgcgccttcgggtgagcggcggacgggttagtaacacgtgggaacgtgcccttctctaaggaataaccattggaaacgatgactaatgccttatacgcccttcgggggaaagatttatcggagaaggatcggcccgcggtagattagatagttggtggggtaacggcctaccaagtctacgatctatagttgatttgagaggatgatcagcaacactgggactgagacacggcccagactcctacgggaggcagcagtggggaatcttagacaatgggcgaaagcctgatctagccatgccgcgtgagtgatgaaggtcttaggatcgtaaagctctttcgctggggaagataatgactgtacccagtaaagaagtcccggctaactccgtgccagcagccgcggtaatacggaggggactagcgttgttcggaattactgggcgtaaagcgtgcgtaggcggatcagcaagtatggggtgaaatcccggggctcaaccccggaactgccttgtaaactgttggtctagagttcgagagaggtgagtggaactccgagtgtagaggtgaaattcgtagatattcggaagaacaccagtggcgaaggcggctcactggctcgatactgacgctgaggtacgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatagacatcgtactttccagagatggatcggtcagttcggctggatgtcatacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggtggtgacagtgggttaatccccaaaagccatctcagttcggattggggtctgcaactcgaccccatgaagtcggaatcgctagtaatcgcgtaacagcatgacgcggtgaatacgttcccgggccttgtacacaccgcccgtcacaccatgggagttgggtccacccgaaggccgtgcgccaaccttttcgaaggaggcagcggaccacggtgagctcagcgactggggtgaagtcgtaacaaggtagccctaggggaacctggggctggatcacctcctttctaa

SEQ ID NO: 7963 - DNA, 1474 bp, Roseovarius sp. MCTG156 2b
  ref <308>: DATABASE ACCESSION NUMBER: NCBI ACCESSION: NZ_JQLS01000008.1
  ref <309>: DATABASE ENTRY DATE: 2019-04-01
  ref <313>: RELEVANT RESIDUES IN SEQ ID NO: (1)..(1474)
caacttgagagtttgatcctggctcagaacgaacgctggcggcaggcctaacacatgcaagtcgagcgagatcttcggatctagcggcggacgggtgagtaacgcgtgggaacgtaccctcttctgcgggatagccactggaaacggtgagtaataccgcatacgcccttcgggggaaagatttatcggaggaggatcggcccgcgttggattaggtagttggtggggtaatggcctaccaagcctacgatccatagctggttttagaggatgatcagccacactgggactgagacacggcccagactcctacgggaggcagcagtggggaatcttagacaatgggcgcaagcctgatctagccatgccgcgtgagtgacgaaggccttagggtcgtaaagctctttcgcctgtgatgataatgacagtagcaggtaaagaaaccccggctaactccgtgccagcagccgcggtaatacggagggggttagcgttgttcggaattactgggcgtaaagcgcacgtaggcggattggaaagtatggggtgaaatcccagggctcaaccctggaacggcctcataaacttccagtctggagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatagatatcgtagttaccagagatggtttcgtcagttcggctggatatcatacaggtgctgcatggctgtcgtcagctcgtgtcgtgagatgttcggttaagtccggcaacgagcgcaacccacatccctagttgccagcaggtcaagctgggcactctatggaaactgcccgtgataagcgggaggaaggtgtggatgacgtcaagtcctcatggcccttacgggttgggctacacacgtgctacaatggtggtgacaatgggttaatcccaaaaagccatctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgacgacggtgcgctaacctcgcaagaggaggcagccggccacggtaggctcagcgactggggtgaagtcgtaacaaggtagccgtaggggaacctgcggctggatcacctcctttctaa

SEQ ID NO: 7964 - DNA, 1474 bp, Roseovarius tolerans
  ref <308>: DATABASE ACCESSION NUMBER: NCBI ACCESSION: NZ_FOBO01000044.1
  ref <309>: DATABASE ENTRY DATE: 2019-04-01
  ref <313>: RELEVANT RESIDUES IN SEQ ID NO: (1)..(1474)
caacttgagagtttgatcctggctcagaacgaacgctggcggcaggcctaacacatgcaagtcgagcgaacccttcggggttagcggcggacgggtgagtaacgcgtgggaacgtaccctcttctgcggaatagccactggaaacggtgagtaataccgcatacgcccttcgggggaaagatttatcggaggaggatcggcccgcgttggattaggtagttggtggggtaatggcctaccaagcctacgatccatagctggttttagaggatgatcagccacactgggactgagacacggcccagactcctacgggaggcagcagtggggaatcttagacaatgggcgcaagcctgatctagccatgccgcgtgtgtgacgaaggccttagggtcgtaaagcactttcgcctgtgatgataatgacagtagcaggtaaagaaaccccggctaactccgtgccagcagccgcggtaatacggagggggttagcgttgttcggaattactgggcgtaaagcgcacgtaggcggatcagaaagttgggggtgaaatcccggggctcaaccccggaactgcctccaaaacttctggtctggagttcgagagaggtgagtggaattgcgagtgtagaggtgaaattcgtagatattcgcaggaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggatcgcggagacgctttccttcagttcggctggatcagtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggtggtgacaatgggttaatccccaaaaaccatctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgacggccgtgcgctaacctcttcggaggaggcagcggaccacggtaagctcagcgactggggtgaagtcgtaacaaggtagccgtaggggaacctgcggctggatcacctcctttctaa

SEQ ID NO: 7965 - DNA, 1530 bp, Rothia aeria
  ref <308>: DATABASE ACCESSION NUMBER: NCBI ACCESSION: NZ_AP017895.1
  ref <309>: DATABASE ENTRY DATE: 2019-04-01
  ref <313>: RELEVANT RESIDUES IN SEQ ID NO: (1)..(1530)
ttgtaacggagagtttgatcctggctcaggacgaacgctggcggcgtgcttaacacatgcaagtcgaacgatgaagcggtgcttgcaccgtggattagtggcgaacgggtgagtaatacgtgagtgacctacctttgactctgggataagcctgggaaactgggtctaataccggatacgaccaatctctgcatggggtgttggtggaaagcgttatggagtggttttagatgggctcacggcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctgttagcatcgaagaagcgaaagtgacggtaggtgcagagaaagcgccggctaactacgtgccagcagccgcggtaatacgtagggcgcgagcgttgtccggaattattgggcgtaaagagcttgtaggcggttggtcgcgtctgctgtgaaaggccggggcttaactccggttttgcagtgggtacgggctaactagagtgcagtaggggagactggaattcctggtgtagcggtggaatgcacagatatcaggaggaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcattagatcgcgtcagagatggcgtttcccttcggggctggtgtacaggtggtgcatggttgtcgtcagctcgtgtcgtgagatgttgggttaagtcccgcaacgagcgcaaccctcgttctatgttgccagcggttcggccggggactcataggagactgccggggtcaactcggaggaaggtggggatgacgtcaaatcatcatgccccttatgtcttgggcttcacgcatgctacaatggccggtacagagggttgcgatactgtgaggtggagctaatcccttaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtgggggagccgtcgaaggtgggattggcgattgggactaagtcgtaacaaggtagccgtaccggaaggtgcggctggatcacctcctttcta

SEQ ID NO: 7966 - DNA, 1532 bp, Rothia dentocariosa
  ref <308>: DATABASE ACCESSION NUMBER: NCBI ACCESSION: NZ_LR134479.1
  ref <309>: DATABASE ENTRY DATE: 2019-04-01
  ref <313>: RELEVANT RESIDUES IN SEQ ID NO: (1)..(1532)
ttgtaacggagagtttgatcctggctcaggacgaacgctggcggcgtgcttaacacatgcaagtcgaacgatgaagcggtgcttgcaccgtggattagtggcgaacgggtgagtaatacgtgagtgacctacctttgactctgggataagcctgggaaactgggtctaataccggatacgaccaatctctgcatggggtgttggtggaaagcgttatggagtggttttagatgggctcacggcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctgttagcatcgaagaagcgaaagtgacggtaggtgcagagaaagcgccggctaactacgtgccagcagccgctggtaatacgtagggcgcgagcgttgtccggaattattgggcgtaaagagcttgtaggcggttggtcgcgtctgctgtgaaaggccggggcttaactccggttttgcagtgggtacgggctaactagagtgcagtaggggagactggaattcctggtgtagcggtggaatgcacagatatcaggaggaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcattagatcgcgtcagagatggcgtttcccttcggggctggtgtacaggtggtgcatggttgtcgtcagctcgtgtcgtgagatgttgggttaagtcccgcaacgagcgcaaccctcgttctatgttgccagcggttcggccggggactcataggagactgccggggtcaactcggaggaaggtggggatgacgtcaaatcatcatgccccttatgtcttgggcttcacgcatgctacaatggccggtacagagggttgcgatactgtgaggtggagctaatcccttaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggattggcgattgggactaagtcgtaacaaggtagccgtaccggaaggtgcggctggatcacctcctttcta

SEQ ID NO: 7967 - DNA, 1538 bp, Rothia kristinae
  ref <308>: DATABASE ACCESSION NUMBER: NCBI ACCESSION: NZ_NOIV01000009.1
  ref <309>: DATABASE ENTRY DATE: 2019-04-01
  ref <313>: RELEVANT RESIDUES IN SEQ ID NO: (1)..(1538)
tcaacggagagtttgatcctggctcaggacgaacgctggcggcgtgcttaacacatgcaagtcgaacgctgaagcctggtgcttgcaccgggtggatgagtggcgaacgggtgagtaatacgtgagtgacctgcctttgactctgggataagcctgggaaactgggtctaataccggatgcgactactgcccgcatgggctggtggtggaaagggttatgtactggtcttagatgggctcacggcctatcagctggttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcggaagtgacggtacctgcagaagaagcgccggctaactacgtgccagcagccgcggtaatacgtagggcgcaagcgttgtccggaattattgggcgtaaagagctcgtaggcggcttgtcgcgtctgctgtgaaagcccggggcttaactccgggtgtgcagtgggtacgggcaggctagagtgcagtaggggtaactggaattcctggtgtagcggtgaaatgcgcagatatcaggaggaacaccgatggcgaaggcaggttactgggctgttactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacaccggatcgttccagagatggttcttcccttttgggctggtgtacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggatgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccgatggcctaacccttgtggagggagtcgtcgaaggtgggactggcgattgggactaagtcgtaacaaggtagccgtaccggaaggtgcggctggatcacctcctttctaagga

SEQ ID NO: 7968 - DNA, 1534 bp, Rothia mucilaginosa
  ref <308>: DATABASE ACCESSION NUMBER: NCBI ACCESSION: NZ_PKIQ01000008.1
  ref <309>: DATABASE ENTRY DATE: 2019-04-01
  ref <313>: RELEVANT RESIDUES IN SEQ ID NO: (1)..(1534)
tcaacggagagtttgattctggctcaggacgaacgctggcggcgtgcttaacacatgcaagtcgaacgatgaagcctagcttgctaggtggattagtggcgaacgggtgagtaatacgtgagtaacctacctttaactctgggataagcctgggaaactgggtctaataccggatacgaccaatctccgcatggggtgttggtggaaagcgttatgtagtggttatagatgggctcacggcctatcagcttgttggtgaggtaacggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctgttagcagggaagaagagaaattgacggtacctgcagagaaagcgccggctaactacgtgccagcagccgcggtaatacgtagggcgcgagcgttgtccggaattattgggcgtaaagagcttgtaggcggtttgtcgcgtctgctgtgaaaggccggagcttaactccgtgtattgcagtgggtacgggcagactagagtgcagtaggggagactggaattcctggtgtagcggtggaatgcgcagatatcaggaggaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaagaaattgacgggggcccgcacaagcggcggagcatgcggattaattcgatgcaacgcgaagaaccttaccaaggcttgacatatactggaccgcatcagagatggtgtttcccttcggggctggtatacaggtggtgcatggttgtcgtcagctcgtgtcgtgagatgttgggttaagtcccgcaacgagcgcaaccctcgttctatgttgccagcacgttatggtggggactcataggagactgccggggtcaactcggaggaaggtggggatgacgtcaaatcatcatgccccttatgtcttgggcttcacgcatgctacaatggccggtacagagggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccaaagccggtggcctaaccttttggagggagccgtctaaggtgggattggcgattgggactaagtcgtaacaaggtagccgtaccggaaggtgcggctggatcacctcctttctaagga

SEQ ID NO: 7969 - DNA, 1536 bp, Rothia sp. HMSC069C03
  ref <308>: DATABASE ACCESSION NUMBER: NCBI ACCESSION: NZ_KZ627124.1
  ref <309>: DATABASE ENTRY DATE: 2019-04-01
  ref <313>: RELEVANT RESIDUES IN SEQ ID NO: (1)..(1536)
tcaacggagagtttgattctggctcaggacgaacgctggcggcgtgcttaacacatgcaagtcgaacgatgaagcctagcttgctaggtggattagtggcgaacgggtgagtaatacgtgagtaacctacctttaactctgggataagcctgggaaactgggtctaataccggatacgaccaatctccgcatggggtgttggtggaaagcgttatgtagtggttatagatgggctcacggcctatcagcttgttggtgaggtaacggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctgttagcagggaagaagagagattgacggtacctgcagagaaagcgccggctaactacgtgccagcagccgcggtaatacgtagggcgcgagcgttgtccggaattattgggcgtaaagagcttgtaggcggtttgtcgcgtctgctgtgaaaggccggagcttaactccgtgtattgcagtgggtacgggcagactagagtgcagtaggggagactggaattcctggtgtagcggtggaatgcgcagatatcaggaggaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaagaaattgacgggggcccgcacaagcggcggagcatgcggattaattcgatgcaacgcgaagaaccttaccaaggcttgacatatactggaccgcatcagagatggtgtttcccttcggggctggtatacaggtggtgcatggttgtcgtcagctcgtgtcgtgagatgttgggttaagtcccgcaacgagcgcaaccctcgttctatgttgccagcacgttatggtggggactcataggagactgccggggtcaactcggaggaaggtggggatgacgtcaaatcatcatgccccttatgtcttgggcttcacgcatgctacaatggccggtacagagggttgcgatactgtgaggtggagctaatccctaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccaaagccggtggcctaacccttttgggagggagccgtctaaggtgggattggcgattgggactaagtcgtaacaaggtagccgtaccggaaggtgcggctggatcacctcctttctaagga

SEQ ID NO: 7970 - DNA, 1531 bp, Rothia sp. HSID18067
  ref <308>: DATABASE ACCESSION NUMBER: NCBI ACCESSION: NZ_RBMF01000007.1
  ref <309>: DATABASE ENTRY DATE: 2019-04-01
  ref <313>: RELEVANT RESIDUES IN SEQ ID NO: (1)..(1531)
ttgtaacggagagtttgatcctggctcaggacgaacgctggcggcgtgcttaacacatgcaagtcgaacgatgaagcggtgcttgcaccgtggattagtggcgaacgggtgagtaatacgtgagtgacctacctttgactctgggataagcctgggaaactgggtctaataccggatacgaccaatctctgcatggggtgttggtggaaagcgttatggagtggttttagatgggctcacggcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctgttagcatcgaagaagcgaaagtgacggtaggtgcagagaaagcgccggctaactacgtgccagcagccgcggtaatacgtagggcgcgagcgttgtccggaattattgggcgtaaagagcttgtaggcggttggtcgcgtctgctgtgaaaggccggggcttaactccggttttgcagtgggtacgggctaactagagtgcagtaggggagactggaattcctggtgtagcggtggaatgcacagatatcaggaggaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcattagatcgcgtcagagatggcgtttcccttcggggctggtgtacaggtggtgcatggttgtcgtcagctcgtgtcgtgagatgttgggttaagtcccgcaacgagcgcaaccctcgttctatgttgccagcggttcggccggggactcataggagactgccggggttaactcggaggaaggtggggatgacgtcaaatcatcatgccccttatgtcttgggcttcacgcatgctacaatggccggtacagagggttgcgatactgtgaggtggagctaatcccttaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggattggcgattgggactaagtcgtaacaaggtagccgtaccggaaggtgcggctggatcacctcctttcta

SEQ ID NO: 7971 - DNA, 1531 bp, Rothia sp. HSID18069; identical to SEQ ID NO: 7970
  ref <308>: DATABASE ACCESSION NUMBER: NCBI ACCESSION: NZ_RBMG01000010.1
  ref <309>: DATABASE ENTRY DATE: 2019-04-01
  ref <313>: RELEVANT RESIDUES IN SEQ ID NO: (1)..(1531)

SEQ ID NO: 7972 - DNA, 1531 bp, Rothia sp. Olga
  ref <308>: DATABASE ACCESSION NUMBER: NCBI ACCESSION: NZ_NDFM01000017.1
  ref <309>: DATABASE ENTRY DATE: 2019-04-01
  ref <313>: RELEVANT RESIDUES IN SEQ ID NO: (1)..(1531)
ttgtaacggagagtttgatcctggctcaggacgaacgctggcggcgtgcttaacacatgcaagtcgaacgatgaagcctagcttgctaggtggattagtggcgaacgggtgagtaatacgtgagtgacctacctttgactctgggataagcctgggaaactgggtctaataccggatacgaccaatctctgcatggggtgttggtggaaagcgttatggagtggttttagatgggctcacggcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctgttagcatcgaagaagcgaaagtgacggtaggtgcagagaaagcgccggctaactacgtgccagcagccgcggtaatacgtagggcgcgagcgttgtccggaattattgggcgtaaagagcttgtaggcggttggtcgcgtctgctgtgaaaggccggggcttaactccggttttgcagtgggtacgggctaactagagtgcagtaggggagactggaattcctggtgtagcggtggaatgcacagatatcaggaggaacaccgatggcgaaggcaggtctctgggctgtaactgacgctgagaagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcattagatcgcgtcagagatggcgtttcccttcggggctggtgtacaggtggtgcatggttgtcgtcagctcgtgtcgtgagatgttgggttaagtcccgcaacgagcgcaaccctcgttctatgttgccagcggttcggccggggactcataggagactgccggggtcaactcggaggaaggtggggatgacgtcaaatcatcatgccccttatgtcttgggcttcacgcatgctacaatggccggtacagagggttgcgatactgtgaggtggagctaatcccttaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggattggcgattgggactaagtcgtaacaaggtagccgtaccggaaggtgcggctggatcacctcctttcta

SEQ ID NO: 7973 - DNA, 1562 bp, Rubeoparvulum massiliense
  ref <308>: DATABASE ACCESSION NUMBER: NCBI ACCESSION: NZ_CVPE01000004.1
  ref <309>: DATABASE ENTRY DATE: 2019-04-01
  ref <313>: RELEVANT RESIDUES IN SEQ ID NO: (1)..(1562)
attttacggagagtttgatcctggctcaggacgaacgctggcggcgtgcctaatacatgcaagtcgagcgcgtgaagcgtgtaaaatccttcgggaggctacatgtggaacgagcggcggacgggtgagtaacacgtgggcaacctgcctgtaagaccgggataactccgggaaaccggggctaataccggataggaatcaagaccgcatggtcttgattggaaagcacaagatgcacttacagatgggcccgcggcgcattagctagttggtggggtaacggcctaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggattgtaaaactctgttcttagggacgaacaagtgggatggactcccaccctgacggtacctaaggagaaagccccggctaactacgtgccagcagccgcggtaatacgtagggggcgagcgttgtccggaattattgggcgtaaagcgcgcgtaggcggtttcttaagtctggtgtgaaaggccacggctcaaccgtggaatggcattggaaactgggagacttgagtgtaggagaggaaagtggaattcctggtgtagcggtgaaatgcgtagatatcaggaggaataccagtggcgaaggcgactttctggcctataactgacgctgaggtgcgaaagcgtggggagcaaacaggattagataccctggtagtccacgccgtaaacgatgagtgctaggtgttagggggcaccaccccttagtgccgaagttaacgcattaagcactccgcctggggagtacggccgcaaggctgaaactcaaaggaattgacgggggcccgcacaagcagtggagcatgtggtttaattcgaagcaacgcgaagaaccttaccaggacttgacatcccgatgacccctctagagatagaggcttctcttcggagacatcggtgacaggtggtgcatggttgtcgtcagctcgtgtcgtgagatgttgggttaagtcccgcaacgagcgcaacccttgtccttagttgccagcattcagttgggcactctagggagactgccggtgacaaaccggaggaaggtggggatgacgtcaaatcatcatgccccttatgtcctgggctacacacgtgctacaatggttggtacagagggatgcgagaccgtgaggtggagccaatcccataaaaccaatctcagttcggattgcaggctgcaactcgcctgtatgaagccggaattgctagtaatcgcggatcagcatgccgcggtgaatacgttcccgggccttgtacacaccgcccgtcacaccacgagagtttgcaacacccgaagtcggtgaggtaaccgcaaggagccagccgccgaaggtggggcagatgattggggtgaagtcgtaacaaggtatccgtaccggaaggtgcggatggatcacctcctttctatgga

SEQ ID NO: 7974 - DNA, 1487 bp, Rubidibacter lacunae
  ref <308>: DATABASE ACCESSION NUMBER: NCBI ACCESSION: NZ_ASSJ01000063.1
  ref <309>: DATABASE ENTRY DATE: 2019-04-01
  ref <313>: RELEVANT RESIDUES IN SEQ ID NO: (1)..(1487)
catggagagtttgatcctggctcaggatgaacgctggcggtcggcctaacacatgcaagtcgaacgaagtcttcggacttagtggcggacgggtgagtaacacgtgagaatctgccctctggagggggacaaccgttggaaacggcggctaataccccatatgccttcgggtgaaacgctccggcgccagaggaggagctcgcggccgattagctagttggtggggtaacggcctaccaaggcagcgatcggtagctggtctgagaggacgagcagccacactgggactgagacacggcccagactcctacgggaggcagcagtggggaattttccgcaatgggcgaaagcctgacggagccagaccgcgtgcgggaagaaggcctttgggttgtaaaccgcttttctcagggaagaagacagtgacggtacctgaggaatcagcctcggctaactccgtgccagcagccgcggtaatacggaggaggcaagcgttatccggaattattgggcgtaaagcgttcgcaggcggcctgacaagtctgctgtcaaagcccgcggcttaaccgcggagaggcagtggaaactgccaggctagagtgcggtaggggtagggggaattcccagtgtagcggtgaaatgcgtagagattgggaagaacaccagtggcgaaagcgccctactggaccgcaactgacgctcagggacgaaagctagggtagcgaaagggattagatacccctgtagtcctagccgtaaacgatggagactaggtgtggctcgtatcgacccgagccgtgccgtagctaacgcgttaagtctcccgcctggggagtacgcgcgcaagcgtgaaactcaaaggaattgacgggggcccgcacaagcggtggaggatgtggtttaattcgatgcaacgcgaagaaccttaccagggcttgacatccggcgaacctttgggaaaccgaagggtgccttcgggagcgccgtgacaggtggtgcatggctgtcgtcagctcgtgtcgtgagatgttgggttaagtcccgcaacgagcgcaaccctcgtccttagttgccagcatttagttgggcactctaaggagactgctggtgacaaaccggaggaaggtggggacgacgtcaagtcagcatgccccttatgccctgggctacacacgtcctacaatggtcgggacaacgggcagcgaacccgcgagggcgagcgaatcccagcaaacccggtctcagttcagattgcaggctgcaactcgcctgcatgaaggaggaatcgctagtaatcgcaggtcagcatactgcggtgaattcgttcccgggccttgtacacaccgcccgtcacaccatggaagctggccacgcccgaagtcgttactctaacctacgggaggagggcgccgaaggcagggttggtgactggggtgaagtcgtaacaaggtagccgtaccggaaggtgtggctggatcacctcctta

SEQ ID NO: 7975 - DNA, 1458 bp, Rubrimonas cliftonensis
  ref <308>: DATABASE ACCESSION NUMBER: NCBI ACCESSION: NZ_FNQM01000020.1
  ref <309>: DATABASE ENTRY DATE: 2019-04-01
  ref <313>: RELEVANT RESIDUES IN SEQ ID NO: (1)..(1458)
caacttgagagtttgatcctggctcagaacgaacgctggcggcaggcctaacacatgcaagtcgagcgcacctttcggggtgagcggcggacgggtgagtaacgcgtgggaacgtgccctcctgtttgggataaccactggaaacggtggctaaaaccgaatgcgccctacgggggaagggaggatcggcccgcgttggattagatagttggtggggtaacggcctaccaagtctgcgatccatacctggtttgagaggatgatcaggcacactgggactgagacacggcccagactcctacgggaggcagcagtggggaatcatagacaatgggggaaaccctgatcttgccatgccgcgtggacgatgaaggccttagggttgtaaagtcctttcaccggtgaagataatgacggtagccggagaagaagccccggctaactccgtgccagcagccgcggtaatacggagggggctagcgttgttcggaattactgggcgtaaagcgcgcgtaggcgggctgttaagtcgggggtgaaatcccggggctcaaccccggaactgccttcgatactggcagcctagaggacggtagaggctagtggaatggcgagtgtagaggtgaaattcgtagatattcgccggaacaccagtggcgaaggcgactggctggaccgttactgacgctgaggtgcgaaagcgtggggagcaaacaggattagataccctggtagtccacgccgtaaacgatgaatgctagtcgtcagggggcatgcctcgtggtgacgcagctaacgcattaagcattccgcctggggagtacggccgcaaggttaaaactcaaaggaattgacgggggcccgcacaagcggtggagcatgtggtttaattcgaagcaacgcgcagaaccttaccacctcttgacatccccaacgcggacacctgagagggagtccttcagttcggctggttgggtgacaggtgctgcatggctgtcgtcagctcgtgtcgtgagatgttgggttaagtcccgcaacgagcgcaacccacgcccttagttgccagcattcagttgggcactctaggggaaccgccggtgataagccggaggaaggtgtggatgacgtcaagtcctcatggcccttacgaggtgggctacacacgtgctacaatggcagtgacaatgggttaatcctcaaaagctgtctcagttcggattggggtctgcaactcgaccccatgaagtcggaatcgctagtaatcgcgtaacagcatgacgcggtgaatacgttcccgggccttgtacacaccgcccgtcacaccatgggaattgggtctacccgaagacggtgcgccaaccgcaaggaggcagccggccacggtaggctcagtgactggggtgaagtcgtaacaaggtagccgtaggggaacctgcggctggatcacctcctttctaa

SEQ ID NO: 7976 - DNA, 1175 bp, Rubritepida flocculans
  ref <308>: DATABASE ACCESSION NUMBER: NCBI ACCESSION: NZ_AUDH01000010.1
  ref <309>: DATABASE ENTRY DATE: 2019-04-01
  ref <313>: RELEVANT RESIDUES IN SEQ ID NO: (1)..(1175)
atgaacctgagagtttgatcctggctcagagcgaacgctggcggaatgcttaacacatgcaagtcgtacgggcagcttcggctgtcagtggcggacgggtgagtaacgcgtaggaacgtgtcctgtgatgggggataacgctgggaaactggcgctaataccgcatatctcctgagggggaaagccgcgaggcgtcatgggagcggcctgcgtccgattaggtagttggtggggtaaaggcctaccaagccttcgatcggtagctggtctgagaggatgatcagccacactgggactgagacacggcccagactcctacgggaggcagcagtggggaatattggacaatgggcgcaagcctgatccagcaattccgcgtgggtgaagaaggtcttcggattgtaaagccctttcggcagggacgatgatgacggtacctgcagaagaagccccggctaacttcgtgccagcagccgcggtaatacgaagggggctagcgttgctcggaatgactgggcgtaaagggcgcgtaggcggtttacacagtcaggcgtgaaattcctgggcttaacctgggggctgcgtttgatacgtgtagacttgagggtggaagaggctcgtggaattcccagtgtagaggtgaaattcgtagatattgggaagaacaccggtggcgaaggcggcgagctggtccatttctgacgctgaggcgcgaaagcgtggggagcaaacaggattagataccctggtagtccacgctgtaaacgatgtgcgctggatgttggggggcttagcccttcagtgtcgtagctaacgcgataagcgcaccgcctggggagtacggccgcaaggttgaaactcaaaggaattgacgggggcccgcacaagcggtggagcatgtggtttaattcgaagcaacgcgcagaaccttaccagctcttgacatccgtcgaacttcgcagagatgcgttggtgcccgcaagggagcggcgagacaggtgctgcatggctgtcgtcagctcgtgtcgtgagatgttgggttaagtcccgcaacgagcgcaaccctcgcctctagttgccagcatgtttgggtgggcactctagaggaactgccggtgacaagccggaggaaggtggggatgacgtcaagtcctcatggcccttatgagctgggc

SEQ ID NO: 7977 - DNA, 1537 bp, Rubrivivax sp. ICH-3
  ref <308>: DATABASE ACCESSION NUMBER: NCBI ACCESSION: NZ_SACT01000002.1
  ref <309>: DATABASE ENTRY DATE: 2019-04-01
  ref <313>: RELEVANT RESIDUES IN SEQ ID NO: (1)..(1537)
agatcgaactgaagagtttgatcctggctcagattgaacgctggcggcatgctttacacatgcaagtcgaacggtaacaggccttcgggtgctgacgagtggcgaacgggtgagtaatgcatcggaacgtgcccagtagtgggggatagcccggcgaaagccggattaataccgcatacgacctacgggtgaaagggggggatcgcaagacctctcgctattggagcggccgatgtcagattaggtagttggtggggtaaaggcctaccaagcctgcgatctgtagctggtctgagaggacgaccagccacactgggactgagacacggcccagactcctacgggaggcagcagtggggaattttggacaatgggcgcaagcctgatccagccatgccgcgtgcgggaagaaggccttcgggttgtaaaccgcttttgtcagggaagaaatcttctgggctaatacctcgggaggatgacggtacctgaagaataagcaccggctaactacgtgccagcagccgcggtaatacgtagggtgcaagcgttaatcggaattactgggcgtaaagcgtgcgcaggcggttgtgcaagacaggtgtgaaatccccgggcttaacctgggaactgcacttgtgactgcacagctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggaaggttccttctcagtaacgtagctaacgcgtgaagttgaccgcctggggagtacggccgcaaggttgaaactcaaaggaattgacggggacccgcacaagcggtggatgatgtggtttaattcgacgcaacgcgaaaaaccttacctacccttgacatgccaggaacttgccagagatggcttggtgctcgaaagagaacctggacacaggtgctgcatggccgtcgtcagctcgtgtcgtgagatgttgggttaagtcccgcaacgagcgcaacccttgccattagttgctacgaaagggcactctaatgggactgccggtgacaaaccggaggaaggtggggatgacgtcaggtcatcatggcccttatgggtagggctacacacgtcatacaatggccggtacagagggctgccaacccgcgagggggagccaatcccagaaaaccggtcgtagtccggatcgcagtctgcaactcgactgcgtgaagtcggaatcgctagtaatcgcggatcagcttgccgcggtgaatacgttcccgggtcttgtacacaccgcccgtcacaccatgggagcgggttccgccagaagtaggtagcctaaccgcaaggagggcgcttaccacggcggggttcgtgactggggtgaagtcgtaacaaggtagccgtatcggaaggtgcggctggatcacctcctttctg

SEQ ID NO: 7978 - DNA, 1555 bp, Rubrobacter aplysinae
  ref <308>: DATABASE ACCESSION NUMBER: NCBI ACCESSION: NZ_LEKH01000008.1
  ref <309>: DATABASE ENTRY DATE: 2019-04-01
  ref <313>: RELEVANT RESIDUES IN SEQ ID NO: (1)..(1555)
ttcggagagtttgatcttggctcaggacgaacgctgacggcgtgctttagacatgcaagtcgaacgagaaaaccctttggggttagtaaagtggcgaacgggtgagtaacacgtgggcaatctgcccttcgttgggggacaaccgggggaaaccccggctaataccccgtaagcttgctaggtcacctgaccttgcaaggagaggtagcttcggccatccggcgaaggaggagcccgcggtacattagcttgttggtgaggtaacggctcaccaaggcgacgatgtatagctggtctgagaggatgatcagccacactgggactgagacacggcccagactcctacgggaggcagcagtcgggaatcttgcacaatgggcgaaagcctgatgcagcaacgccgtgtgagcgatgaaggccctagggtcgtaaagctctgttgttagggacgaagggcgaagggttaatagcccttagcctgacggtacctatcgaggaagccccggctaactacgtgccagcagccgcggtaatacgtagggggcgagcgttgtccggaattattgggcgtaaagggcgcgtaggcggcttggtaagtctgctgtgaaaccttggggctcaaccccaagcgtgcagtggatactgtcaagctagaggatggtagaggccagtggaattcccggtgtagcggtgaaatgcgcagatatcgggaggaacaccagtagcgaaggcggctggctgggccattcctgacgctgaggcgcgaaagcatggggagcgaacaggattagataccctggtagtccatgccgtaaacgatgaacactaggtgtggggggagtcgaatccctccgtgccgaagccaacgcgttaagtgttccgcctggggagtacggccgcaaggctaaaactcaaaagaattgacgggggcccgcacaagcagcggagcatgttctttaattcgatgcaacgcgaagaaccttacctgggcttgacatgcagctgcaagcgcacggaaacgtgtgactttcgaaggtgctgcacaggtgctgcatggctgtcgtcagctcgtgtcgtgagatgttgggttaagtcccgcaacgagcgcaacccctgtcgtgtgttgctaacattaggttgaggactcacgcgagactgccggtgacaaaccggaggaaggtggggacgacgtcaagtcatcatggcccttacgcccagggctagaaacgtgctacaatggcgtacacaaagggcagcaagaccgcaaggtggagcgaatctcatcaaagtacgtctaagttcggatcggggtctgcaattcgaccccgtgaagctggagttgctagtaatcgcggatcagaacgccgcggtgaatgcgttcccgggccttgtacacaccgcccgtcacaccacgggagtaggcaatacccgaagtcggcgcagccaacccttttgcgggaggcggtcggcgaaggtagggcttgcgactggggtgaagtcgtaacaaggtagccgtacctgaaggtgcggctggatcacctcctttctagggaga

SEQ ID NO: 7979 - DNA, 1547 bp, Rubrobacter indicoceani
  ref <308>: DATABASE ACCESSION NUMBER: NCBI ACCESSION: NZ_CP031115.1
  ref <309>: DATABASE ENTRY DATE: 2019-04-01
  ref <313>: RELEVANT RESIDUES IN SEQ ID NO: (1)..(1547)
ggagagtttgatcttggctcaggacgaacgctgacggtgtgctttagacatgcaagtcgaacgagaaaacccttcggggttagtaaagtggcgaacgggtgagtaacacgtgggcaatctgcccctcgcagggggacaaccgggggaaactccggctaataccccgtacgcttgtcggaccgcatggtactgacaaggaaaggtagcttcggccatccggcgagggatgagcccgcggtacattagctagttggtggggtaacggcctaccaaggcgacgatgtatagctggtctgagaggatgatcagccacactgggactgagacacggcccagactcctacgggaggcagcagtcgggaatcttgcacaatgggcgaaagcctgatgcagcaacaccgtgtgagcgatgaaggccctagggtcgtaaagctctgttgttggggacgaagggcgaagggttaatagcccctagcttgacggtacccttcgaggaagccccggctaactacgtgccagcagccgcggtaatacgtagggggcgagcgttgtccggaattattgggcgtaaagagcgtgtaggcggtctggtaagtctgtcgtgaaaggctggggctcaaccctggacgtgcgatggatactgccagactagaggatggtagaggcgagtggaattccgagtgtagcggtgaaatgcgcagatattcggaggaacaccagtagcgaaggcggctcgctggcccattcctgacgctgagacgcgaaagcgtggggagcaaacaggattagataccctggtagtccacgccgtaaacgatgaacactaggtgttgggggagtcgaatccctcggtgccgaagctaacgcgttaagtgttccgcctggggagtacggccgcaaggctaaaactcaaaagaattgacgggggcccgcacaagcagcggagcatgttctttaattcgatgcaacgcgaagaaccttacctggacttgacatgtagctgcaagcgcacggaaacgtgtgaccttagagggtgctacacagatgctgcatggctgtcgtcagctcgtgtcgtgagatgttgggttaagtcccgcaacgagcgcaacccccgtcgtgtgttgccagcattaagttggggactcacgcgagactgccggtgacaaaccggaggaaggtggggacgacgtcaagtcatcatggctcttacgtccagggctagaaacgtgctacaatggcgtacacaaagggcagcgagaccgcgaggtggagcgaatcccatcaaagtacgtctaagttcggatcgtagtctgcaacccgactacgtgaagctggagttgctagtaatcgcggatcagaacgccgcggtgaatacgttcccgggccttgtacacaccgcccgtcacaccacgggagtaagtaatgcccgaagtgggtgcagctaacctcttttgaggaggcggctcacgaaggtaggatttgcgactggggtgaagtcgtaacaaggtagccgtacctgaaggtgcggctggatcacctcctttcta

SEQ ID NO: 7980 - DNA, 1549 bp, Rubrobacter radiotolerans
  ref <308>: DATABASE ACCESSION NUMBER: NCBI ACCESSION: NZ_FWWX01000004.1
  ref <309>: DATABASE ENTRY DATE: 2019-04-01
  ref <313>: RELEVANT RESIDUES IN SEQ ID NO: (1)..(1549)
tcggagagtttgatcttggctcaggacgaacgctgacggtgtgctttagacatgcaagtcgaacgagaaagcccttcggggtgagtaaagtggcgaacgggtgagtaacacgtgggcaacctgcccctcgcagggggacaaccggaggaaactccggctaataccccgtacgcttgtcgagccgcatggcaccgacaaggaaaggtagcttcggccatccggcgagggatgggcccgcggtacattagctagttggtggggtaacggcctaccaaggcgacgatgtatagctggtctgagaggatgatcagccacactgggactgagacacggcccagactcctacgggaggcagcagtcgggaatcttgcacaatgggcgaaagcctgatgcagcaacaccgtgtgagcgatgaaggccctagggtcgtaaagctctgttgttagggacgaagggcgaagggttaatagcccctagcttgacggtacctttcgaggaagccccggctaactacgtgccagcagccgcggtaatacgtagggggcgagcgttgtccggaattattgggcgtaaagagcgtgtaggcggtctggtaagtctgtcgtgaaaggctggggctcaaccctggacgtgcgatggatactgccagactagaggatggtagaggcgagtggaattcccggtgtagcggtgaaatgcgcagatatcgggaggaacaccagtagcgaaggcggctcgctggaccatacctgacgctgagacgcgaaagcgtggggagcaaacaggattagataccctggtagtccacgccgtaaacgatgaacactaggtgttgggggagtcgaatccctcggtgccgaagccaacgcgttaagtgttccgcctggggagtacggccgcaaggctaaaactcaaaagaattgacgggggcccgcacaagcagcggagcatgttctttaattcgatgcaacgcgaagaaccttacctggacttgacatggtgctgcaagcgcacggaaacgtgtgaccttcgagggtgcaccacagatgctgcatggctgtcgtcagctcgtgtcgtgagatgttgggttaagtcccgcaacgagcgcaacccccgtgatgtgttgctagcattcagttgaggactcacatcagactgccggtgacaaaccggaggaaggtggggacgacgtcaagtcatcatggctcttacgtccagggctagaaacgtgctacaatggcgtacacaaagggcagcaagaccgtgaggtggagcgaatcccatcaaagtgcgtctaagttcggatcggagtctgcaactcgactccgtgaagctggagttgctagtaatcgcggatcagaacgccgcggtgaatacgttcccgggccttgtacacaccgcccgtcacaccacgggagtaggtaatgcccgaagtgggtgcagctaaccccttttggggaggcggctcacgaaggtaggatctgcgactggggtgaagtcgtaacaaggtagccgtacctgaaggtgcggctggatcacctcctttcta

SEQ ID NO: 7981 - DNA, 1556 bp, Rubrobacter xylanophilus
  ref <308>: DATABASE ACCESSION NUMBER: NCBI ACCESSION: NC_008148.1
  ref <309>: DATABASE ENTRY DATE: 2019-04-01
  ref <313>: RELEVANT RESIDUES IN SEQ ID NO: (1)..(1556)
ggagagtttgatcttggctcaggacgaacgctggcggcgtgctttaggcatgcaagtcgaacgcgaaagccccttcgggggtgagtagagtggcgaacgggtgagtaacacgtgggtaacctgcccctcgcagggggataaccgggggaaaccccggctaataccccgtacgcttgccggggcgcatgctccggcaaggaaaggtagcttcggccatccggcgagggaggggcccgcggcccattagctagttggtggggtaacggcccaccaaggcgacgatgggtagctggcctgagagggtggtcagccacactgggactgagacacggcccagactcctacgggaggcagcagccaggaatcttgcgcaatgggcgaaagcctgacgcagcaacgccgcgtgggcgatgaaggccttcgggtcgtaaagccctgttgtcggggacgaagggcgaagggttaatagcccctagcctgacggtacccgacgaggaagccccggctaactacgtgccagcagccgcggtaatacgtagggggcgagcgttgtccggaatcattgggcgtaaagagcgtgtaggcggcccggtaagtctgctgtgaaaacccggggctcaaccccgggcgtgcagtggaaactgccgggctagagggcggcagaggcgagtggaattcccggtgtagcggtgaaatgcgcagatatcgggaggaacaccagtagcgaaggcggctcgctgggccgttcctgacgctgagacgcgaaagctaggggagcgaacaggattagataccctggtagtcctagccgtaaacgatgggcactaggtgtggggggagtcgaatccctccgtgccgcagccaacgcgttaagtgccccgcctggggagtacggccgcaaggctaaaactcaaaagaattgacgggggcccgcacaagcagcggagcatgttctttaattcgatgcaacgcgaagaaccttacctgggcttgacatgctggtggtaggcgccggaaacggtggccgacccttcggggagccagcacaggtgctgcatggctgtcgtcagctcgtgtcgtgagatgttgggttaagtcccgcaacgagcgcaacccccgccctgtgttgccagcattgagttggggactcacaggggactgccggtgacaaaccggaggaaggtggggatgacgtcaagtcatcatggcccttatgcccagggctagaaacgtgctacaatggccggtacaatgggctgcgatgccgcgaggcggagcgaatcccatcaaagccggtctaagttcggattggagtctgcaactcgactccatgaaggcggagttgctagtaatcgcggatcagcatgccgcggtgaatacgttcccgggccttgtacacaccgcccgtcacaccacgggagtcggcaatacccgaagcaggcgcagctaacccctcttcggaggggaggcggcttgcgaaggtagggccggcgactggggtgaagtcgtaacaaggtagccgtacctgaaggtgcggctggatcacctcctttcta

SEQ ID NO: 7982 - DNA, 1519 bp, Rudanella lutea
  ref <308>: DATABASE ACCESSION NUMBER: NCBI ACCESSION: NZ_KB913013.1
  ref <309>: DATABASE ENTRY DATE: 2019-04-01
  ref <313>: RELEVANT RESIDUES IN SEQ ID NO: (1)..(1519)
tttacgatggagagtttgatcctggctcaggatgaacgctagcggcaggcctaatacatgcaagtcgaacggtcagcaatgacagtggcgaacgggtgcgtaacgcgtaaggaacctgcccttcactgggggatagctttgcgaaagcgaaggtaaacccgcatggttctgtgggatcgcatggttttacagataaatatttataggtgaaggagggtcttgcgtcggattagttagttggcagggtaacggcctaccaagacgatgatccgtaggggctctgagaggagcggcccccacatggacactgagacacgggtccaactcctacgggaggcagcagtagggaatattgggcaatggccggaaggctgacccagccatgccgcgtggaggaagacggccctctgggttgtaaactccttttatcggggaagaacagcactcttgcgagagtgtgtgacggtactcgaggaataagcaccggctaactccgtgccagcagccgcggtaatacggagggtgcaagcgttgtccggatttattgggtttaaagggtgcgtaggtggtctgataagtctggtttgaaagttggtcgcttaacgatcaagggtggctggatactgttggacttgaatggggtggcggtagccggaatgggttgtgtagcggtgaaatgcatagagatgacccggaacaccgattgcgaaggcaggctactacgccttaattgacactgaggcacgagagcatggggagcaaacaggattagataccctggtagtccatgccgtaaacgatgattactggctgttgggttttcggattcagtggctaagcgaaagcggtaagtaatccacctggggagtacgccggcaacggtgaaactcaaaggaattgacgggggtccgcacaagcggtggagcatgtggtttaattcgatgatacgcgaggaaccttacctgggctagaatgcgcgtgaaggttgtagaaatatgactgtgtagcaatacacacaaagcaaggtgctgcatggctgtcgtcagctcgtgccgtgaggtgttgggttaagtcccgcaacgagcgcaacccctgttatctgttgccagcacgttaaggtggggactcagataagactgcctgcgcaagcagagaggaaggaggggacgacgtcaagtcatcatggcccttacgcccagggcgacacacgtgctacaatggtcggtacagcgggttacgagctggtaacagtgagtcaatctcgaaaagccgatcacagttcggattggggtctgcaactcgaccctatgaagctggaatcgctagtaatcgcgcatcagccatggcgcggtgaatacgttcccggaccttgtacacaccgcccgtcaagccatggaagtcggggggacctgaagctgcccttaaacaaggtggtcagggtaaatctggtaactggggctaagtcgtaacaaggtagccgtaccggaaggtgcggctggaacacctcctttctggagct

SEQ ID NO: 7983 - DNA, 1465 bp, Ruegeria atlantica
  ref <308>: DATABASE ACCESSION NUMBER: NCBI ACCESSION: NZ_CYPU01000053.1
  ref <309>: DATABASE ENTRY DATE: 2019-04-01
  ref <313>: RELEVANT RESIDUES IN SEQ ID NO: (1)..(1465)
tcaacttgagagtttgatcctggctcagaacgaacgctggcggcaggcttaacacatgcaagtcgagcgcaccttcgggtgagcggcggacgggttagtaacgcgtgggaacataccctttggtacggaatagcctctggaaacggagagtaataccgtatgagcccttcgggggaaagatttatcgccaaaggattggcccgcgttagattaggtagttggtggggtaatggcctaccaagcctacgatctatagctggttttagaggatgatcagcaacactgggactgagacacggcccagactcctacgggaggcagcagtggggaatcttggacaatgggggcaaccctgatccagccatgccgcgtgagtgatgaaggccttagggtcgtaaagctctttcgcctgtgaagataatgacggtagcaggtaaagaaaccccggctaactccgtgccagcagccgcggtaatacggagggggttagcgttgttcggaattactgggcgtaaagcgcacgtaggcggactggaaagttgggggtgaaatcccagggctcaaccctggaactgcctccaaaactatcagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccggcccagagatgggtctttcacttcggtgacctagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaaccttcggggggcaggcggccacggtaggatcagcgactggggtgaagtcgtaacaaggtagccgtaggggaacctgcggctggatcacctcctttctaa

SEQ ID NO: 7984 - DNA, 1467 bp, Ruegeria conchae
  ref <308>: DATABASE ACCESSION NUMBER: NCBI ACCESSION: NZ_RCCT01000013.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcgcctttcggggtgagcggcggacgggttagtaacgcgtgggaatataccctttggtacggaatagcctctggaaacggagagtaataccgtatgagcccttcgggggaaagatttatcgccaaaggattagcccgcgttagattaggtagttggtggggtaatggcctaccaagcctacgatctatagctggttttagaggatgatcagcaacactgggactgagacacggcccagactcctacgggaggcagcagtggggaatcttggacaatgggggcaaccctgatccagccatgccgcgtgagtgatgaaggccttagggtcgtaaagctctttcgcctgtgaagataatgacggtagcaggtaaagaaaccccggctaactccgtgccagcagccgcggtaatacggagggggttagcgttgttcggaattactgggcgtaaagcgcacgtaggcggaccagaaagttgggggtgaaatcccggggctcaaccccggaactgcctccaaaactattggtctagagttcgagagaggtgagtggaattccaagtgtagaggtgaaattcgtagatatttggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccgggaccggtccagagatggatctttcacttcggtgactcggtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaaccttttggaggcagcggaccacggtaggatcagcgactggggtgaagtcgtaacaaggtagccgtaggggaacctgcggctggatcacctcctttctaa

SEQ ID NO: 7985 - DNA, 1469 bp, Ruegeria halocynthiae
  ref <308>: DATABASE ACCESSION NUMBER: NCBI ACCESSION: NZ_FNNP01000024.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcgcccttcggggtgagcggcggacgggttagtaacgcgtgggaatatacccttttctacggaatagcctctggaaacggagagtaataccgtatgagcccttcgggggaaagatttatcgggaaaggattagcccgcgttagattaggtagttggtggggtaatggcctaccaagcctacgatctatagctggttttagaggatgatcagcaacactgggactgagacacggcccagactcctacgggaggcagcagtggggaatcttggacaatgggggcaaccctgatccagccatgccgcgtgagtgatgaaggccttagggtcgtaaagctctttcgcctgtgaagataatgacggtagcaggtaaagaaaccccggctaactccgtgccagcagccgcggtaatacggagggggttagcgttgttcggaattactgggcgtaaagcgcacgtaggcggactggaaagtatggggtgaaatcccagggctcaaccctggaactgcctcataaactcccagtcttgagttcgagagaggtgagtggaattccaagtgtagaggtgaaattcgtagatatttggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccctggaccgctggagagattcagctttctcgtaagagaccaggtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgccaacctttcgaggaggcagcggaccacggtaggatcagcgactggggtgaagtcgtaacaaggtagccctaggggaacctggggctggatcacctcctttctaa

SEQ ID NO: 7986 - DNA, 1467 bp, Ruegeria kandeliae
  ref <308>: DATABASE ACCESSION NUMBER: NCBI ACCESSION: NZ_QEHM01000021.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcaccttcgggtgagcggcggacgggttagtaacgcgtgggaacgtgcccttctctacggaatatcctcgggaaactgagagcaatgccgtatacgccctttgggggaaagatttatcggagaaggatcggcccgcgttagattaggtagttggtggggtaatggcctaccaagcctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgcctgtgatgataatgacagtagcaggtaaagaaaccccggctaactccgtgccagcagccgcggtaatacggagggggttagcgttgttcggaattactgggcgtaaagcgcacgtaggcggattggaaagttgggggtgaaatcccagggctcaaccctggaactgcctccaaaactcccagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcgggcagtatactgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggaccgtcccagagatgggtctttcacttcggtgaccgagtgacaggtgctgcatggctgtcgtcagctcgtgtcgtgagatgttcggttaagtccggcaacgagcgcaacccacatctttagttgccagcagttcggctgggcactctaaagaaactgcccgtgataagcgggaggaaggtgtggatgacgtcaagtcctcatggcccttacgggttgggctacacacgtgctacaatggtggtgacagtgggttaatccccaaaagccatctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaagacggtgcgccaacctttcgaggaggcagctggccacggtaagctcagcgactggggtgaagtcgtaacaaggtagccgtaggggaacctgcggctggatcacctcctttctaa

SEQ ID NO: 7987 - DNA, 1469 bp, Ruegeria lacuscaerulensis
  ref <308>: DATABASE ACCESSION NUMBER: NCBI ACCESSION: NZ_FQYJ01000014.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcgcccttcggggtgagcggcggacgggttagtaacgcgtgggaacgtgccctttggtacggaatagcctctggaaacggagagtaataccgtatgagcccttcgggggaaagatttatcgccaaaggatcggcccgcgttagattaggtagttggtggggtaatggcctaccaagcctacgatctatagctggttttagaggatgatcagcaacactgggactgagacacggcccagactcctacgggaggcagcagtggggaatcttggacaatgggggcaaccctgatccagccatgccgcgtgagtgatgaaggccctagggtcgtaaagctctttcgcctgtgaagataatgacggtagcaggtaaagaaaccccggctaactccgtgccagcagccgcggtaatacggagggggttagcgttgttcggaattactgggcgtaaagcgcacgtaggcggactggaaagttgggggtgaaatcccggggctcaaccccggaacggcctccaaaactatcagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccgggaccggtccagagatggatctttcacttcggtgactcggtgacaggtgctgcatggctgtcgtcagctcgtgtcgtgagatgttcggttaagtccggcaacgagcgcaacccacgtccttagttgccagcagttcggctgggcactctaaggaaactgcccgtgataagcgggaggaaggtgtggatgacgtcaagtcctcatggcccttacgggttgggctacacacgtgctacaatggcagtgacaatgggttaatccccaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttcgggggggcaggcggccacggtaggatcagcgactggggtgaagtcgtaacaaggtagccgtaggggaacctgcggctggatcacctcctttctaa

SEQ ID NO: 7988 - DNA, 1467 bp, Ruegeria litorea
  ref <308>: DATABASE ACCESSION NUMBER: NCBI ACCESSION: NZ_FWFO01000011.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcgcccttcggggtgagcggcggacgggttagtaacgcgtgggaatatacccaaaggtagggaatagcctctggaaacggagagtaataccctatgtgcccttcgggggaaagatttatcgcctttggattagcccgcgttagattaggtagttggtggggtaatggcctaccaagcctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggatcagaaagtaaggggtgaaatcccagggctcaaccctggaactgcctcttaaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggacaactccagagatggagccttccttcgggacctagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcaactacagtgggttaatccccaaaagttgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgccaacctttcgagggggcagcggaccacggtgagctcagcgactggggtgaagtcgtaacaaggtagccgtaggggaacctgcggctggatcacctcctttctaa

SEQ ID NO: 7989 - DNA, 1467 bp, Ruegeria mediterranea
  ref <308>: DATABASE ACCESSION NUMBER: NCBI ACCESSION: NZ_ONZG01000001.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcgcccttcggggtgagcggcggacgggttagtaacgcgtgggaatatacccaaaggtagggaatagcctctggaaacggagagtaataccctatgggcccttcgggggaaaaatttatcgcctttggattcgcccgcgttagattaggtagttggtggggtaatggcctaccaagcctacgatctatagctggttttagaggatgatcagcaacactgggactgagacacagcccagactcctacgggaggcagcagtggggaatcttggacaatgggcgcaagcctgatccagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggatcagaaagttgggggtgaaatcccggggctcaaccccggaactgcctccaaaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcagcaagcatgcttgttggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggacaactccagagatggagccttccttcgggacctagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcaactacagtgggttaatccccaaaagttgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgccaacctttcgagggggcagcggaccacggtgagctcagcgactggggtgaagtcgtaacaaggtagccgtaggggaacctgcggctggatcacctcctttctaa

SEQ ID NO: 7990 - DNA, 1469 bp, Ruegeria meonggei
  ref <308>: DATABASE ACCESSION NUMBER: NCBI ACCESSION: NZ_FWFP01000022.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcacctttcggggtgagcggcggacgggttagtaacgcgtgggaatataccctttggtacggaatagcctctggaaacggagagtaataccgtatgagcccttcgggggaaagatttatcgccaaaggattagcccgcgttagattaggtagttggtggggtaatggcctaccaagcctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgcctgtgaagataatgacggtagcaggtaaagaaaccccggctaactccgtgccagcagccgcggtaatacggagggggttagcgttgttcggaattactgggcgtaaagcgcacgtaggcggactggaaagtatggggtgaaatcccagggctcaaccctggaactgcctcataaactatcagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccctggaccgctggagagattcagctttctcgtaagagaccaggtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttcgggggggcaggcggccacggtaggatcagcgactggggtgaagtcgtaacaaggtagccgtaggggaacctgcggctggatcacctcctttctaa

SEQ ID NO: 7991 - DNA, 1467 bp, Ruegeria pomeroyi
  ref <308>: DATABASE ACCESSION NUMBER: NCBI ACCESSION: NC_003911.12
  ref <309>: DATABASE ENTRY DATE: 2019-04-01
  ref <313>: RELEVANT RESIDUES IN SEQ ID NO: (1)..(1467)
taacttgagagtttgatcctggctcagaacgaacgctggcggcaggcctaacacatgcaagtcgagcgcgcccttcggggtgagcggcggacgggttagtaacgcgtgggaacgtaccctttggtagggaatagccactggaaacggtgagtaataccctatgagcccttcgggggaaagatttatcgccaaaggatcggcccgcgttagattaggtagttggtggggtaatggcctaccaagcctacgatctatagctggttttagaggatgatcagcaacactgggactgagacacggcccagactcctacgggaggcagcagtggggaatcttggacaatgggggcaaccctgatccagccatgccgcgtgagtgaagaaggccttagggtcgtaaagctctttcgcctgtgaagataatgacggtagcaggtaaagaaaccccggctaactccgtgccagcagccgcggtaatacggagggggttagcgttgttcggaattactgggcgtaaagcgcgcgtaggcggaccagaaagttgggggtgaaatcccggggctcaaccccggaactgcctccaaaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctgctcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctcggaccgtcccagagatgggtctttcacttcggtgaccgagtgacaggtgctgcatggctgtcgtcagctcgtgtcgtgagatgttcggttaagtccggcaacgagcgcaacccacacccttagttgccagcattcagttgggcactctaggggaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaagacggtgcgccaacctttcgaggaggcagctggccacggtaggctcagcgactggggtgaagtcgtaacaaggtagccgtaggggaacctgcggctggatcacctcctttctaa

SEQ ID NO: 7992 - DNA, 1469 bp, Ruegeria sp. 6PALISEP08
  ref <308>: DATABASE ACCESSION NUMBER: NCBI ACCESSION: NZ_LGXZ01000029.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcacctttcggggtgagcggcggacgggttagtaacgcgtgggaatataccctttggtacggaatagcctctggaaacggagagtaataccgtatgagcccttcgggggaaagatttatcgccaaaggattagcccgcgttagattaggtagttggtggggtaatggcctaccaagcctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgcctgtgaagataatgacggtagcaggtaaagaaaccccggctaactccgtgccagcagccgcggtaatacggagggggttagcgttgttcggaattactgggcgtaaagcgcacgtaggcggactggaaagttgggggtgaaatcccagggctcaaccctggaactgcctccaaaactatcagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccggcccagagatgggtctttcacttcggtgacctagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgccaacctttcgaggaggcagcggaccacggtaggatcagcgactggggtgaagtcgtaacaaggtagccgtaggggaacctgcggctggatcacctcctttctaa

SEQ ID NO: 7993 - DNA, 1469 bp, Ruegeria sp. A3M17
  ref <308>: DATABASE ACCESSION NUMBER: NCBI ACCESSION: NZ_QOCF01000030.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcttaacacatgcaagtcgagcgctctcttcggagggagcggcggacgggttagtaacgcgtgggaacgtacccagatctaaggaatagccactggaaacggtgagtaataccttatacgcccttcgggggaaagatttatcggatttggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgcctgtgaagataatgacggtagcaggtaaagaaaccccggctaactccgtgccagcagccgcggtaatacggagggggttagcgttgttcggaattactgggcgtaaagcgcacgtaggcggactggaaagtatggggtgaaatcccagggctcaaccctggaactgcctcataaactatcagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccggcccagagatgggtctttcacttcggtgacctagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttcgggggggcaggcggccacggtaggatcagcgactggggtgaagtcgtaacaaggtagccgtaggggaacctgcggctggatcacctcctttctaa

SEQ ID NO: 7994 - DNA, 1464 bp, Ruegeria sp. AD91A
  ref <308>: DATABASE ACCESSION NUMBER: NCBI ACCESSION: NZ_CP031946.1
  ref <309>: DATABASE ENTRY DATE: 2019-04-01
  ref <313>: RELEVANT RESIDUES IN SEQ ID NO: (1)..(1464)
caacttgagagtttgatcctggctcagaacgaacgctggcggcaggcctaacacatgcaagtcgagcgcaccttcgggtgagcggcggacgggttagtaacgcgtgggaatataccctttggtacggaatagcctctggaaacggagagtaataccgtatgagcccttcgggggaaagatttatcgccaaaggattagcccgcgttagattaggtagttggtggggtaatggcctaccaagcctacgatctatagctggttttagaggatgatcagcaacactgggactgagacacggcccagactcctacgggaggcagcagtggggaatcttggacaatgggggcaaccctgatccagccatgccgcgtgagtgatgaaggccttagggtcgtaaagctctttcgcctgtgaagataatgacggtagcaggtaaagaaaccccggctaactccgtgccagcagccgcggtaatacggagggggttagcgttgttcggaattactgggcgtaaagcgcacgtaggcggactggaaagttgggggtgaaatcccagggctcaaccctggaactgcctccaaaactatcagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccggcccagagatgggtctttcacttcggtgacctagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaaccttttgggggcagcggaccacggtaggatcagcgactggggtgaagtcgtaacaaggtagccgtaggggaacctgcggctggatcacctcctttctaa

SEQ ID NO: 7995 - DNA, 1467 bp, Ruegeria sp. ANG-R; identical to SEQ ID NO: 7984
  ref <308>: DATABASE ACCESSION NUMBER: NCBI ACCESSION: NZ_JWLJ01000026.1
  ref <309>: DATABASE ENTRY DATE: 2019-04-01
  ref <313>: RELEVANT RESIDUES IN SEQ ID NO: (1)..(1467)

SEQ ID NO: 7996 - DNA, 1467 bp, Ruegeria sp. ANG-S4
  ref <308>: DATABASE ACCESSION NUMBER: NCBI ACCESSION: NZ_JWLK01000013.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcgcctttcggggtgagcggcggacgggttagtaacgcgtgggaatatgcccttttctgcggaatagcctctggaaacggagagtaataccgcatacgcccttcgggggaaagatttatcggagaaggattagcccgcgttagattaggtagttggtggggtaatggcctaccaagcctacgatctatagctggttttagaggatgatcagcaacactgggactgagacacggcccagactcctacgggaggcagcagtggggaatcttggacaatgggggcaaccctgatccagccatgccgcgtgagtgatgaaggccttagggtcgtaaagctctttcgcctgtgaagataatgacggtagcaggtaaagaaaccccggctaactccgtgccagcagccgcggtaatacggagggggttagcgttgttcggaattactgggcgtaaagcgcacgtaggcggatcggaaagttgggggtgaaatcccggggctcaaccccggaactgcctccaaaactatcggtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccgggaccggtccagagatgggcctttcacttcggtgactcggtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggtggtgacagtgggttaatccccaaaagccatctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaaccttttggaggcagcggaccacggtaggatcagcgactggggtgaagtcgtaacaaggtagccgtaggggaacctgcggctggatcacctcctttctaa

SEQ ID NO: 7997 - DNA, 1465 bp, Ruegeria sp. Alg231-54; identical to SEQ ID NO: 7983
  ref <308>: DATABASE ACCESSION NUMBER: NCBI ACCESSION: NZ_FREZ01000015.1
  ref <309>: DATABASE ENTRY DATE: 2019-04-01
  ref <313>: RELEVANT RESIDUES IN SEQ ID NO: (1)..(1465)

SEQ ID NO: 7998 - DNA, 1469 bp, Ruegeria sp. EL01
  ref <308>: DATABASE ACCESSION NUMBER: NCBI ACCESSION: NZ_OMPS01000003.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcttaacacatgcaagtcgagcgctctcttcggagggagcggcggacgggttagtaacgcgtgggaacgtacccagatctaaggaatagccactggaaacggtgagtaataccttatacgcccttcgggggaaagatttatcggatttggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggggcaaccctgatccagccatgccgcgtgagtgatgaaggccttagggtcgtaaagctctttcgcctgtgaagataatgacggtagcaggtaaagaaaccccggctaactccgtgccagcagccgcggtaatacggagggggttagcgttgttcggaattactgggcgtaaagcgcacgtaggcggactggaaagtatggggtgaaatcccagggctcaaccctggaactgcctcataaactcccagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccctggaccgctggagagattcagctttctcgtaagagaccaggtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttcgggggggcaggcggccacggtaggatcagcgactggggtgaagtcgtaacaaggtagccgtaggggaacctgcggctggatcacctcctttctaa

SEQ ID NO: 7999 - DNA, 1566 bp, Ruegeria sp. NKC1-1
  ref <308>: DATABASE ACCESSION NUMBER: NCBI ACCESSION: NZ_CP031092.1
  ref <309>: DATABASE ENTRY DATE: 2019-04-01
  ref <313>: RELEVANT RESIDUES IN SEQ ID NO: (1)..(1566)
tttatggagagtttgatcctggctcaggacgaacgctggcggcgtgcctaatacatgcaagtcgagcgggcctccggaggtgcttgcacctccggaaggccagcggcggacgggtgagtaacacgtgggcaacctgccttggagtgcgggataacaccgggaaaccggtgctaataccgcatacgtcctctttcgcgcctgcgagaggggagaaagacggtcgatggccgtcgctcgaagaggggcccgcggcgcattagcttgttggtgggatcaaagcctaccaaggcgacgatgcgttgccgacctgagagggtgatcggccacactgggactgagacacggcccagactcctgcgggaggcagcagtagggaatcatccgcaatgggcgcaagcctgacggtgcaacgccgcgtgagtgaggaaggttttcggatcgtaaagctctgttgtgagggaagaacagctcttggaggaaatgccgggagtttgccggtacctcaccagaaagccccggctaactacgtgccagcagccgcggtaatacgtagggggcaagcgttgtccggaattattgggcgtaaagggcacgcaggcggtacggcaagtctgatgtgaaaggccggcgctcaacgccggaatggcattggaaactgtcgcacttgagtacagaagaggagagtggaattccacgtgtagcggtgaaatgcgtagagatgtggaggaacaccagtggcgaaggcgactctctggtctgtgactgacgctgaggtgcgaaagcgtggggagcgaacaagattagataccttggtagtccacgccgtaaacgatgagtgctaggtgttaggggtttcgatacccgtagtgccgaagcaaacgcaataagcactccgcctggggagtacgaccgcaaggttgaaactcaaaggaattgacgggggcccgcacaagcggtggagcatgtggtttaattcgaagcaacgcgaaggaccttaccaggccttgacatcctctgatcgccttggagacaaggtttcccctttggggcagagtgacaggtggtgcatggttgtcgtcagctcgtgtcgtgagatgttgggttaagtcccgtaacgagcgcaacccttgaatgtcgttgccagcattaagttgggcactcgacattgactgccggtgacaaaccggaggaaggcggggatgacgtcaaatcatcatgccccttatggcctgggcgacacacgtgctacaatggacggtacaacgggcagcgaagccgcgaggtggagcgaatccccgcaaaagccgttctcagttcggattgcaggctgcaacccgcctgcatgaagctggaatcgctagtaatcgcggatcagcatgccgcggtgaatacgttcccgggccttgtacacaccgcccgtcacaccacgagagccggcaacacccgaagtcggtgagcgaaccctgatgggacgcagccgccgaaggtggggctggtgattggggtgaagtcgtaacaaggtatccctaccggaaggtggggatggatcacctcctttctaaggag

SEQ ID NO: 8000 - DNA, 1467 bp, Ruegeria sp. P4; identical to SEQ ID NO: 3673
  ref <308>: DATABASE ACCESSION NUMBER: NCBI ACCESSION: NZ_QJJO01000027.1
  ref <309>: DATABASE ENTRY DATE: 2019-04-01
  ref <313>: RELEVANT RESIDUES IN SEQ ID NO: (1)..(1467)

SEQ ID NO: 8001 - DNA, 1454 bp, Ruegeria sp. PBVC088; identical to SEQ ID NO: 5182
  ref <308>: DATABASE ACCESSION NUMBER: NCBI ACCESSION: NZ_LZNT01000120.1
  ref <309>: DATABASE ENTRY DATE: 2019-04-01
  ref <313>: RELEVANT RESIDUES IN SEQ ID NO: (1)..(1454)

SEQ ID NO: 8002 - DNA, 1465 bp, Ruegeria sp. R11; identical to SEQ ID NO: 5959
  ref <308>: DATABASE ACCESSION NUMBER: NCBI ACCESSION: NZ_DS999054.1
  ref <309>: DATABASE ENTRY DATE: 2019-04-01
  ref <313>: RELEVANT RESIDUES IN SEQ ID NO: (1)..(1465)

SEQ ID NO: 8003 - DNA, 1510 bp, Rufibacter immobilis
  ref <308>: DATABASE ACCESSION NUMBER: NCBI ACCESSION: NZ_RJJE01000005.1
  ref <309>: DATABASE ENTRY DATE: 2019-04-01
  ref <313>: RELEVANT RESIDUES IN SEQ ID NO: (1)..(1510)
tggagagtttgatcctggctcaggatgaacgctagcggcaggcctaatacatgcaagtcgaacggggtccttcggggcccagtggcgcacgggtgcgtaacgcgtatgcaacctaccttcgactgggggatagcccggagaaatccggattaataccgcataacgcgacttgaggacatccgaaggtcgctaaagatttatcggtcggagatgggcatgcgtgccattagctagttggtggggtaacggcccaccaaggcgacgatggctaggggttctgagaggacggtcccccacactggcactgagatacgggccagactcctacgggaggcagcagtagggaatattgggcaatgggcggaagcctgacccagccatgccgcgtgcaggatgaaggccttctgggttgtaaactgcttttatcggggaagaaaacgcccatgcgtgggaaactgacggtacccgaggaataagcaccggctaactccgtgccagcagccgcggtaatacggagggtgcaagcgttgtccggatttattgggtttaaagggtgcgtaggcggcccattaagtcagcggtgaaagcccggggctcaaccccggaaccgccgttgatactggtgggcttgagtatggacgaggttggcggaattgagggtgtagcggtgaaatgcttagataccctcaagaacaccgattgcgtaggcagctaactaggccataactgacgctgaggcacgaaagcgtggggagcgaacaggattagataccctggtagtccacgccgtaaacgatgattactcgatgtcggcgacagactgtcggcgtcttagcgaaagcgttaagtaatccacctggggagtacgcccgcaagggtgaaactcaaaggaattgacgggggcccgcacaagcggtggagcatgtggtttaattcgatgatacgcgaggaaccttacctaggctagaatgcgcgtgacggtaccggagacggtacttcccttcggggcacaaagcaaggtgctgcatggctgtcgtcagctcgtgccgtgaggtgttgggttaagtcccgcaacgagcgcaacccctatccctagttgccagcacgtcaaggtggggactctagggagactgcctccgcaaggagcgaggaaggcggggacgacgtcaagtcatcatggcccttacgcctagggctacacacgtgctacaatggcgcatacagagggtcgctacccggtgacggggtgccaatctcagaaagtgcgtctcagttcggatcggagtctgcaactcgactccgtgaagctggaatcgctagtaatcgcgtatcagcaatgacgcggtgaatacgttcccgggccttgtacacaccgcccgtcaagccatggaagtcagggagacctgaaggccgtcacccacaaggagcggcttagggtaaaactggtaactggggctaagtcgtaacaaggtagccgtaccggaaggtgcggctggatcacctcctttct

SEQ ID NO: 8004 - DNA, 1508 bp, Rufibacter roseus
  ref <308>: DATABASE ACCESSION NUMBER: NCBI ACCESSION: NZ_LRML01000033.1
  ref <309>: DATABASE ENTRY DATE: 2019-04-01
  ref <313>: RELEVANT RESIDUES IN SEQ ID NO: (1)..(1508)
tggagagtttgatcctggctcaggatgaacgctagcggcaggcctaatacatgcaagtcgaacggtgccttcgggcacagtggcgcacgggtgcgtaacgcgtatgcaacctaccttgaactgggggatagcccggagaaatccggattaataccgcataagaccacgtgagggcatccgagtgtggttaaagatttatcggttcaagatgggcatgcgtgccattagctagttggtggtgtaacggaccaccaaggcgacgatggctagggggtctgagaggatggtcccccacactggcactgagatacgggccagactcctacgggaggcagcagtagggaatattgggcaatgggcggaagcctgacccagccatgccgcgtgcaggatgaaggccttctgggttgtaaactgcttttgacagggaagaaaacacccatgcgtggggaactgacggtacctgtagaataagcaccggctaactccgtgccagcagccgcggtaatacggagggtgcaagcgttgtccggatttattgggtttaaagggtgcgtaggcggccgattaagtcagcggtgaaagcccggggctcaaccccggaaccgccgttgatactggtcggcttgagtacagacgaggtaggcggaattgaagatgtagcggtgaaatgcttagatatcttcaagaacaccgattgcgtaggcagcttactaggctgtaactgacgctgaggcacgaaagcgtggggagcgaacaggattagataccctggtagtccacgccgtaaacgatgattactcgatgtcggcgatagaatgtcggcgtcttagcgaaagcgttaagtaatccacctggggagtacgcccgcaagggtgaaactcaaaggaattgacgggggcccgcacaagcggtggagcatgtggtttaattcgatgatacgcgaggaaccttacctaggctagaatgcgcgtgaccgccccagagatggggcttcccttcggggcacaaagcaaggtgctgcatggctgtcgtcagctcgtgccgtgaggtgttgggttaagtcccgcaacgagcgcaacccctatccctagttgccagcacgtcaaggtggggactctagggagactgcctccgcaaggagcgaggaaggcggggacgacgtcaagtcatcatggcccttacgcctagggctacacacgtgctacaatggcgcatacagagggtcgctacctggcaacaggatgccaatctcaaaaagtgcgtctcagttcggatcggggtctgcaactcgaccccgtgaagctggaatcgctagtaatcgcgtatcagcaatgacgcggtgaatacgttcccgggccttgtacacaccgcccgtcaagccatggaagtcagggagacctgaagaccgtcaccgtcaaggagcggtttagggtaaaactggtaactggggctaagtcgtaacaaggtagccgtaccggaaggtgcggctggatcacctcctttct

SEQ ID NO: 8005 - DNA, 1514 bp, Rufibacter ruber
  ref <308>: DATABASE ACCESSION NUMBER: NCBI ACCESSION: NZ_LRMM01000126.1
  ref <309>: DATABASE ENTRY DATE: 2019-04-01
  ref <313>: RELEVANT RESIDUES IN SEQ ID NO: (1)..(1514)
acaatggagagtttgatcctggctcaggatgaacgctagcggcaggcctaatacatgcaagtcgaacggggcccttcggggcccagtggcgcacgggtgcgtaacgcgtatgcaacctgccttgaactgggggatagcccggagaaatccggattaataccgcatgacaccatatgagggcatctgagtatggtcaaagatttatcggttcaagatgggcatgcgtgccattagctagttggtggtgtaacggaccaccaaggcgacgatggctaggggttctgagaggacggtcccccacactggcactgagatacgggccagactcctacgggaggcagcagtagggaatattgggcaatgggcggaagcctgacccagccatgccgcgtgcaggatgaaggccttctgggttgtaaactgcttttaccagggaagaaaacacccatgcgtggggaactgacggtacctggggaataagcaccggctaactccgtgccagcagccgcggtaatacggagggtgcaagcgttgtccggatttattgggtttaaagggtgcgtaggcggccccttaagtcagcggtgaaagcccggggctcaaccccggaaccgccgttgatactggggggcttgagtacggacgaggtgggcggaattgaggatgtagcggtgaaatgcttagatatcctcaagaactccgattgcgtaggcagctcactaggccgtaactgacgctgaggcacgaaagcgtggggagcgaacaggattagataccctggtagtccacgccgtaaacgatggatactcgatgtcggcgacagactgtcggcgtcttagcgaaagcgttaagtatcccacctggggagtacgcccgcaagggtgaaactcaaaggaattgacgggggcccgcacaagcggtggagcatgtggtttaattcgatgatacgcgaggaaccttacctaggctagaatgcgcgtgaccgccccagagatggggcttcccttcggggcacaaagcaaggtgctgcatggctgtcgtcagctcgtgccgtgaggtgttgggttaagtcccgcaacgagcgcaacccctatccctagttgccagcacgtcaaggtggggactctagggagactgcctccgcaaggagcgaggaaggcggggacgacgtcaagtcatcatggcccttacgcctagggctacacacgtgctacaatggcgcatacagagggtcgctacccggcaacgggatgccaatctcacaaagtgcgtctcagttcggatcggggtctgcaactcgaccccgtgaagctggaatcgctagtaatcgcgtatcagcaatgacgcggtgaatacgttcccgggccttgtacacaccgcccgtcaagccatggaagtcagggagacctgaaggccgtcaccgttcaggagcggcttagggtaaaactggtaactggggctaagtcgtaacaaggtagccgtaccggaaggtgcggctggatcacctcctttct

SEQ ID NO: 8006 - DNA, 1511 bp, Rufibacter sp. DG15C
  ref <308>: DATABASE ACCESSION NUMBER: NCBI ACCESSION: NZ_CP010776.1
  ref <309>: DATABASE ENTRY DATE: 2019-04-01
  ref <313>: RELEVANT RESIDUES IN SEQ ID NO: (1)..(1511)
tggagagtttgatcctggctcaggatgaacgctagcggcaggcctaatacatgcaagtcgaacgggtgcagcaatgcaccagtggcgcacgggtgcgtaacgcgtatgcaacctaccttcaactgggggatagcccggagaaatccggattaataccgcataacacccttcgatggcatctgaagagggttaaagatttatcggttggagatgggcatgcgtgccattagctagttggcggggtaacggcccaccaaggctacgatggctaggggttctgagaggacggtcccccacactggcactgagatacgggccagactcctacgggaggcagcagtagggaatattgggcaatgggcggaagcctgacccagccatgccgcgtgcaggatgaaggccttctgggttgtaaactgcttttaccagggaagaaaacacccatgcgtggggaactgacggtacctggggaataagcaccggctaactccgtgccagcagccgcggtaatacggagggtgcaagcgttgtccggatttattgggtttaaagggtgcgtaggcggccccttaagtcagtggtgaaagcccgcggctcaaccgcggaactgccattgatactggggggcttgagtacagacgaggtaggcggaattgaagatgtagcggtgaaatgcttagatatcttcaagaacaccgattgcgtaggcagcttactaggctgtaactgacgctgaggcacgaaagcgtggggagcgaacaggattagataccctggtagtccacgccgtaaacgatgattactcgatgtcggcgatagaccgtcggcgtcttagcgaaagcgttaagtaatccacctggggagtacgcccgcaagggtgaaactcaaaggaattgacgggggcccgcacaagcggtggagcatgtggtttaattcgatgatacgcgaggaaccttacctaggctagaatgcgcgtgacggtaccggagacggtacttcccttcggggcacaaagcaaggtgctgcatggctgtcgtcagctcgtgccgtgaggtgttgggttaagtcccgcaacgagcgcaacccctacctttagttgccagcacgtaacggtggggactctaaagggactgcctccgcaaggagtgaggaaggcggggacgacgtcaagtcatcatggcccttacgcctagggctacacacgtgctacaatgggcggtacagagggtcgctacctggtgacaggatgccaatctcaaaaagccgctctcagttcggatcgaagtctgcaactcgacttcgtgaagctggaatcgctagtaatcgcgtatcagcaatgacgcggtgaatacgttcccgggccttgtacacaccgcccgtcaagccatggaagtcagggagacctgaaggcggtaaccgtcaaaggagccgcttagggtaaaactggtaactggggctaagtcgtaacaaggtagccgtaccggaaggtgcggctggatcacctcctttct

SEQ ID NO: 8007 - DNA, 1508 bp, Rufibacter sp. DG31D
  ref <308>: DATABASE ACCESSION NUMBER: NCBI ACCESSION: NZ_CP010777.1
  ref <309>: DATABASE ENTRY DATE: 2019-04-01
  ref <313>: RELEVANT RESIDUES IN SEQ ID NO: (1)..(1508)
tggagagtttgatcctggctcaggatgaacgctagcggcaggcctaatacatgcaagtcgaacggggtagcaatacccagtggcgcacgggtgcgtaacgcgtatgcaacctaccttgaactgggggatagccttccgaaagggagattaataccgcataagacaacttgagggcatctgagggttgttaaagatttatcggttcaagatgggcatgcgtgccattagctagttggcggggtaagggcccaccaaggcgacgatggctagggggtctgagaggatggtcccccacactggcactgagatacgggccagactcctacgggaggcagcagtagggaatattgggcaatgggcggaagcctgacccagccatgccgcgtgcaggatgaaggccttctgggttgtaaactgcttttatcagggaagaaaacacccatgcgtggggaactgacggtacctgaggaataagcaccggctaactccgtgccagcagccgcggtaatacggagggtgcaagcgttgtccggatttattgggtttaaagggtgcgtaggcggcccattaagtcagtggtgaaagcccggggctcaaccccggaaccgccattgatactggtgggcttgagtatggacgaggttggcggaattgagggtgtagcggtgaaatgcttagataccctcaagaacaccgattgcgtaggcagctaactaggccataactgacgctgaggcacgaaagcgtggggagcgaacaggattagataccctggtagtccacgccgtaaacgatgattactcgatgtcggcgacagactgtcggcgtcttagcgaaagcgttaagtaatccacctggggagtacgcccgcaagggtgaaactcaaaggaattgacgggggcccgcacaagcggtggagcatgtggtttaattcgatgatacgcgaggaaccttacctaggctagaatgcgcgtgacggtaccggagacggtacttcccttcggggcacaaagcaaggtgctgcatggctgtcgtcagctcgtgccgtgaggtgttgggttaagtcccgcaacgagcgcaacccctatccctagttgccagcacgtcaaggtggggactctagggagactgcctccgcaaggagtgaggaaggcggggacgacgtcaagtcatcatggcccttacgcctagggctacacacgtgctacaatggcgcatacagagggtcgctacctggtgacaggatgccaatctcagaaagtgcgtctcagttcggatcggagtctgcaactcgactccgtgaagctggaatcgctagtaatcgcgtatcagcaatgacgcggtgaatacgttcccgggccttgtacacaccgcccgtcaagccatggaagtcagggagacctgaaggccgtcacccacaaggagcggcttagggtaaaactggtaactggggctaagtcgtaacaaggtagccgtaccggaaggtgcggctggatcacctcctttct

SEQ ID NO: 8008 - DNA, 1511 bp, Rufibacter sp. R-22-1c-1
  ref <308>: DATABASE ACCESSION NUMBER: NCBI ACCESSION: NZ_RJJD01000009.1
  ref <309>: DATABASE ENTRY DATE: 2019-04-01
  ref <313>: RELEVANT RESIDUES IN SEQ ID NO: (1)..(1511)
tggagagtttgatcctggctcaggatgaacgctagcggcaggcctaatacatgcaagtcgaacggggtccttcggggcccagtggcgcacgggtgcgtaacgcgtatgcaacctaccttctgctgggggatagcccggagaaatccggattaataccgcataaggccacgtgaggacatccgagtgtggttaaagatttatcggcagaagatgggcatgcgtgccattagctagttggtggggtaagggcccaccaaggcgacgatggctaggggttctgagaggacggtcccccacactggcactgagatacgggccagactcctacgggaggcagcagtagggaatattgggcaatgggcggaagcctgacccagccatgccgcgtgcaggacgaaggccttctgggttgtaaactgcttttacaggggaagaaaacacccatgcgtggggaactgacggtaccctgggaataagcaccggctaactccgtgccagcagccgcggtaatacggagggtgcaagcgttgtccggatttattgggtttaaagggtgcgtaggcggcttcttaagtcagcggtgaaagcccggggctcaaccccggaaccgccgttgatactgggaggcttgagtatggacgaggttggcggaattgagggtgtagcggtgaaatgcttagataccctcaagaacaccgattgcgtaggcagctaactaggccataactgacgctgaggcacgaaagcgtggggagcgaacaggattagataccctggtagtccacgccgtaaacgatgattactcgatgtcggcgacagaccgtcggcgtcttagcgaaagcgttaagtaatccacctggggagtacgcccgcaagggtgaaactcaaaggaattgacgggggcccgcacaagcggtggagcatgtggtttaattcgatgatacgcgaggaaccttacctaggctagaatgcgcgtgacggtaccggagacggtacttcccttcggggcacaaagcaaggtgctgcatggctgtcgtcagctcgtgccgtgaggtgttgggttaagtcccgcaacgagcgcaacccctatccctagttgccagcacgtcaaggtggggactctagggagactgcctccgcaaggagcgaggaaggcggggacgacgtcaagtcatcatggcccttacgcctagggctacacacgtgctacaatggcgcatacagagggtcgctacctggtgacaggatgccaatctcacaaagtgcgtctcagttcggatcggagtctgcaactcgactccgtgaagctggaatcgctagtaatcgcgtatcagcaatgacgcggtgaatacgttcccgggccttgtacacaccgcccgtcaagccatggaagtcagggagacctgaaggccgtcaccgtcaaaggagcggcttagggtaaaactggtaactggggctaagtcgtaacaaggtagccgtaccggaaggtgcggctggatcacctcctttct

SEQ ID NO: 8009 - DNA, 1516 bp, Rufibacter tibetensis
  ref <308>: DATABASE ACCESSION NUMBER: NCBI ACCESSION: NZ_CP012643.1
  ref <309>: DATABASE ENTRY DATE: 2019-04-01
  ref <313>: RELEVANT RESIDUES IN SEQ ID NO: (1)..(1516)
tacaatggagagtttgatcctggctcaggatgaacgctagcggcaggcctaatacatgcaagtcgaacggcgtccctcggggcgcagtggcgcacgggtgcgtaacgcgtatgcaacctaccttgaactgggggatagcccggagaaatccggattaataccgcataacaccatgtgagggcatctgagtatggttaaagattcattggttcaagatgggcatgcgtgccattagctagttggtggtgtaacggaccaccaaaggctacgatggctaggggttctgagaggacggtcccccacactggcactgagatacgggccagactcctacgggaggcagcagtagggaatattgggcaatgggcggaagcctgacccagccatgccgcgtgcaggatgaaggccttctgggttgtaaactgcttttatcagggaagaaaacacccatgcgtggggaactgacggtacctgaggaataagcaccggctaactccgtgccagcagccgcggtaatacggagggtgcaagcgttgtccggatttattgggtttaaagggtgcgtaggcggcccattaagtcagtggtgaaagcccggggctcaaccccggaaccgccattgatactggtgggcttgagtatggacgaggttggcggaattgagggtgtagcggtgaaatgcttagataccctcaagaacaccgattgcgtaggcagctaactaggccataactgacgctgaggcacgaaagcgtggggagcgaacaggattagataccctggtagtccacgccgtaaacgatgattactcgatgtcggcgacagactgtcggcgtcttagcgaaagcgttaagtaatccacctggggagtacgcccgcaagggtgaaactcaaaggaattgacgggggcccgcacaagcggtggagcatgtggtttaattcgatgatacgcgaggaaccttacctaggctagaatgcgcgtgacgggctcagaaatgggccttcccttcggggcacaaagcaaggtgctgcatggctgtcgtcagctcgtgccgtgaggtgttgggttaagtcccgcaacgagcgcaacccctatccctagttgccagcacgtcaaggtggggactctagggagactgccttcgcaagaagtgaggaaggcggggacgacgtcaagtcatcatggcccttacgcctagggctacacacgtgctacaatggcgcatacagagggtcgctacctggtgacaggatgccaatctcaaaaagtgcgtctcagttcggatcggagtctgcaactcgactccgtgaagctggaatcgctagtaatcgcgtatcagcaacgacgcggtgaatacgttcccgggccttgtacacaccgcccgtcaagccatggaagtcagggagacctgaaggcggtaaccacctaggagccgcttagggtaaaactggtaactggggctaagtcgtaacaaggtagccgtaccggaaggtgcggctggatcacctcctttct

SEQ ID NO: 8010 - DNA, 1023 bp, Ruminiclostridium cellobioparum
  ref <308>: DATABASE ACCESSION NUMBER: NCBI ACCESSION: NZ_JHYD01000091.1
  ref <309>: DATABASE ENTRY DATE: 2019-04-01
  ref <313>: RELEVANT RESIDUES IN SEQ ID NO: (1)..(1023)
gtcttagcggcggacgggtgagtaacgcgtgggcaacctgcctttcacagggggataacacagggaaacttgtgctaataccgcataacacagcgaggtagcattaccttgttgtcaaaggagcaatccggtgatagatgggcccgcgtccaattagctagttggtgatgtaacggaccaccaaggcgacgattggtagccgaactgagaggttgatcggccacattgggactgagacacggcccagactcctacgggaggcagcagtggggaatattgcacaatgggggaaaccctgatgcagcaacgccgcgtgaaggatgaaggttttcggattgtaaacttctttagtcagggacgaaacaaatgacggtacctgaagaataagccacggctaactacgtgccagcagccgcggtaatacgtaggtggcgagcgttgtccggaattactgggtgtaaagggcgtgtaggcgggaatgtaagtcagatgtgaaatcccagggctcaaccctggagctgcatctgaaactatgtttcttgagtgtcggagaggaaagcggaattcctagtgtagcggtgaaatgcgtagatattaggaggaacaccagtggcgaaggcggctttctggacgataactgacgctgaggcgcgaaagcgtggggagcaaacaggattagataccctggtagtccacgctgtaaacgatggatactaggtgtaggaggtatcgaccccttctgtgccggagttaacacaataagtatcccacctggggagtacggccgcaaggttgaaactcaaaggaattgacgggggcccgcacaagcagtggagtatgtggtttaattcgaagcaacgcgaagaaccttaccaaggcttgacatacagatgaatagtgcagagatgtgctagtccttcgggacatctgtacaggtggtgcatggttgtcgtcagctcgtgtcgtgagatgttgggttaagtcccgcaacgagcgcaacccctgttgttagttgataacatt

SEQ ID NO: 8011 - DNA, 1668 bp, Ruminiclostridium hungatei
  ref <308>: DATABASE ACCESSION NUMBER: NCBI ACCESSION: NZ_MZGX01000062.1
  ref <309>: DATABASE ENTRY DATE: 2019-04-01
  ref <313>: RELEVANT RESIDUES IN SEQ ID NO: (1)..(1668)
ttaatttgagagtttgatcctggctcaggacgaacgctggcggcgtgcctaacacatgcaagtcgagcggtttcatgtttaacactgaatattctaactatgctggttatagccagcgtcttgtgagcgaacgaagtaagcgagcaacacgcgtttttcaaaatgtgccaacacaaaaggttgagcaaagatgaaaacagcatacatagatatagagtattgagtgttaaacatgagatagcggcggacgggtgagtaacgcgtgggcaacctgcctatcacagggggataacacagggaaacttgtgctaataccgcataacacaacgaggtagcattaccttgttgtcaaaggagcaatccggtgatagatgggcccgcgtccaattagctagttggtggtgtaatggaccaccaaggcgacgattggtagccgaactgagaggttgatcggccacattgggactgagacacggcccagactcctacgggaggcagcagtggggaatattgcacaatgggggaaaccctgatgcagcaacgccgcgtgaaggatgaaggttttcggattgtaaacttctttagtcagggacgaataaatgacggtacctgaagaataagccacggctaactacgtgccagcagccgcggtaatacgtaggtggcgagcgttgtccggaattactgggtgtaaagggcgtgtaggcgggaatgtaagtcagatgtgaaatcccagggcttaaccctggagctgcatctgaaactatgtttcttgagtgccggagaggaaagcggaattcctagtgtagcggtgaaatgcgtagatattaggaggaacaccagtggcgaaggcggctttctggacggtaactgacgctgaggcgcgaaagcgtggggagcaaacaggattagataccctggtagtccacgctgtaaacgatggatactaggtgtaggaggtatcgaccccttctgtgccggagttaacacaataagtatcccacctggggagtacggccgcaaggttgaaactcaaaggaattgacgggggcccgcacaagcagtggagtatgtggtttaattcgaagcaacgcgaagaaccttaccaaggcttgacatacagtggaatatggcagagatgtcatagcccttcggggctgctgtacaggtggtgcatggttgtcgtcagctcgtgtcgtgagatgttgggttaagtcccgcaacgagcgcaacccctgtcgttagttgataacattaagatgatcactctagcgagactgccggtgataaatcggaggaaggtggggacgacgtcaaatcatcatgccccttatgtcttgggctacacacgtactacaatggctattacaatgagaagctaagccgcaaggtggagcaaatctataaaaatagtcccagttcagattgtgggctgcaacccgcccacatgaagtcggaattgctagtaatggcaggtcagcatactgccgtgaatacgttcccgggccttgtacacaccgcccgtcacaccatgagagtctgcaacacccgaagtcgatagtctaaccgcaagggggacgtcgccgaaggtggggccgatgattggggtgaagtcgtaacaaggtagccgtatcggaaggtgcggctggatcacctcctttctaagga

SEQ ID NO: 8012 - DNA, 1461 bp, Ruminiclostridium papyrosolvens
  ref <308>: DATABASE ACCESSION NUMBER: NCBI ACCESSION: NZ_ATAY01000084.1
  ref <309>: DATABASE ENTRY DATE: 2019-04-01
  ref <313>: RELEVANT RESIDUES IN SEQ ID NO: (1)..(1461)
taatttgagagtttgatcctggctcaggacgaacgctggcggcgtgcctaacacatgcaagtcgagcggagttaattgaaagcttgcttttgattaacttagcggcggacgggtgagtaacgcgtgggcaacctgcctgttacagggggataacacagggaaacttgtgctaataccgcataacacagcgagaaagcattttcttgttgtcaaaggagcaatccggtaatagatgggcccgcgtccaattagctagttggtgatgtaacggaccaccaaggcgacgattggtagccgaactgagaggttgatcggccacattgggactgagacacggcccagactcctacgggaggcagcagtggggaatattgcacaatgggggaaaccctgatgcagcaacgccgcgtgaaggatgaaggttttcggattgtaaacttctttagtcagggacgaataaatgacggtacctgaagaataagccacggctaactacgtgccagcagccgcggtaatacgtaggtggcaagcgttgtccggaattactgggtgtaaagggcgtgtaggcgggaatgtaagtcagatgtgaaatcccagagcttaactctggagctgcatctgaaactatgtttcttgagtgccggagaggaaagcggaattcctagtgtagcggtgaaatgcgtagatattaggaggaacaccagtggcgaaggcggctttctggacggtaactgacgctgaggcgcgaaagcgtggggagcaaacaggattagataccctggtagtccacgctgtaaacgatggatactaggtgtaggaggtatcgaccccttctgtgccggagttaacacaataagtatcccacctggggagtacggccgcaaggttgaaactcaaaggaattgacgggggcccgcacaagcagtggagtatgtggtttaattcgaagcaacgcgaagaaccttaccaaggcttgacatatagcggaatacggcagagatgtcgtagtccttcgggactgctatacaggtggtgcatggttgtcgtcagctcgtgtcgtgagatgttgggttaagtcccgcaacgagcgcaacccttgttgctagttgataacattaagatgatcactctagcgagactgccggtgataaatcggaggaaggtggggacgacgtcaaatcatcatgccccttatgtcttgggctacacacgtactacaatggctataacagagggaagctaagctgcaaagtggagcaaatccccaaaaatagtcccagttcagattgtgggctgcaacccgcccacatgaagtcggaattgctagtaatggcaggtcagcatactgccgtgaatacgttcccgggccttgtacacaccgcccgtcacaccatgagagtctgcaacacccgaagtcgatagtctaaccgcaaggaggacgtcgccgaaggtggggccgat

SEQ ID NO: 8013 - DNA, 1370 bp, Ruminiclostridium sufflavum
  ref <308>: DATABASE ACCESSION NUMBER: NCBI ACCESSION: NZ_QKMR01000053.1
  ref <309>: DATABASE ENTRY DATE: 2019-04-01
  ref <313>: RELEVANT RESIDUES IN SEQ ID NO: (1)..(1370)
agcatacataaccggagtattgagtgttgaacatgaggtagcggcggacgggtgagtaacgcgtgggcaacctgcctttcacagggggataacacagggaaacttgtgctaataccgcataacacatcgaggtagcattaccatgatgtcaaaggagcaatccggtgaaagatgggcccgcgtccaattagctagttggtgatgtaacggaccaccaaggcgacgattggtagccgaactgagaggttgatcggccacattgggactgagacacggcccagactcctacgggaggcagcagtggggaatattgcacaatggggggaaccctgatgcagcaacgccgcgtgaaggatgaaggttttcggattgtaaacttctttagtcagggacgaaaaaaatgacggtacctgaagaataagccacggctaactacgtgccagcagccgcggtaatacgtaggtggcgagcgttgtccggaattactgggtgtaaagggcgtgtaggcgggaatgtaagtcagatgtgaaatcccagggcttaactctggagctgcatctgaaactatgtttcttgagtgccggagaggaaagcggaattcctagtgtagcggtgaaatgcgtagatattaggaggaacaccagtggcgaaggcggctttctggacggtaactgacgctgaggcgcgaaagcgtggggagcaaacaggattagataccctggtagtccacgctgtaaacgatggatactaggtgtaggaggtatcgaccccttctgtgccggagttaacacaataagtatcccacctggggagtacggccgcaaggttgaaactcaaaggaattgacgggggcccgcacaagcagtggagtatgtggtttaattcgaagcaacgcgaagaaccttaccaaggcttgacataatattgaatatggcagagatgtcatagtccttcgggacagtattacaggtggtgcatggttgtcgtcagctcgtgtcgtgagatgttgggttaagtcccgcaacgagcgcaacccctgttgttagttgataacattaagatgatcactctaacgagactgccggtgataaatcggaggaaggtggggacgacgtcaaatcatcatgccccttatgtcttgggctacacacgtactacaatggctattacaatgagaagcgaagctgtaaagtggagcaaatctataaaaatagtctcagttcagattgtgggctgcaacccgcccacatgaagtcggaattgctagtaatggcaggtcagcatactgccgtgaatacgttcccgggccttgtacacaccgcccgtcacaccatgagagtctgcaacacccgaagtcgatagtctaaccg

SEQ ID NO: 8014 - DNA, 1533 bp, Ruminococcaceae bacterium AB4001
  ref <308>: DATABASE ACCESSION NUMBER: NCBI ACCESSION: NZ_JHXJ01000055.1
  ref <309>: DATABASE ENTRY DATE: 2019-04-01
  ref <313>: RELEVANT RESIDUES IN SEQ ID NO: (1)..(1533)
ttttgttgagagttcgatcctggctcaggatgaacgctggcggcgtgcttaacacatgcaagtcgaacggagtttaagaaggaagcttgctttcattttaaacttagtggcggacgggtgagtaacgcgtgaggaacctgcccttcagtggggaacaacaactggaaacggttgctaataccgcataatgtcggaaagccgcatgacattccgaccaaaggatttattcgctgaaggatggcctcgcgtccgattagatagttggtgaggtaacggcccaccaagtctacgatcggtagccgaactgagaggttgatcggccacattgggactgagacacggcccagactcctacgggaggcagcagtggggaatattgggcaatgggcgaaagcctgacccagcaacgccgcgtgaaggatgacggtcttcggattgtaaacttctttaattggggaagaacaaaatgacctacccaaagaataagtcacggctaactacgtgccagcagccgcggtaatacgtaggtgacaagcgttatccggatttactgggcgtaaagggcgtgtaggcggtttggcaagtcagaagtgaaattcctgagctcaactcgggcgctgcttctgaaactgctagacttgagtgctggaggggatagcggaattcctagtggagcggtaaaatgcgcagatattaggaagaacaccggtggcgaaggcggctatctggacagtaactgacgctgaggcgcgaaagcgtggggagcaaacaggattagataccctggtagtccacgccgtaaacgatgaatactaggtgtagggggtatcgactccctctgtgccgcagttaacacaataagtattccgcctggggagtacggccgcaaggttgaaactcaaaggaattgacgggggcccgcacaagcagtggattatgtggtttaattcgaagcaacgcgaagaaccttaccagggcttgacatcctctgaccgctctagagatagagtttcccttcggggcagagagacaggtggtgcatggttgtcgtcagctcgtgtcgtgagatgtttggttaagtccaataacgagcgcaacccctatggtcagttgccatcatttagttgggcactctggcaagactgccgcggacaacgcggaggaaggaggggacgacgtcaaatcatcatgccccttatgtcctgggctacacacgtaatacaatggcaacgacagagggcagctaagccgcgaggccgagcaaatccccaaacgttgtcccagttcggactgcaggctgcaacccgcctgcacgaagtcggaattgctagtaatggcaggtcagcatactgccgtgaatacgttcccgggccttgtacacaccgcccgtcacaccatgagagtctgcaatacccgaagtcagtagcctaaccgcaaggagggcgctgccgaaggtagggccgataattggggtgaagtcgtaacaaggtagccgtatcggaaggtgcggctggatcacctcctttctaagga

SEQ ID NO: 8015 - DNA, 1528 bp, Ruminococcaceae bacterium AE2021
  ref <308>: DATABASE ACCESSION NUMBER: NCBI ACCESSION: NZ_JIAE01000001.1
  ref <309>: DATABASE ENTRY DATE: 2019-04-01
  ref <313>: RELEVANT RESIDUES IN SEQ ID NO: (1)..(1528)
ttttatttgagagtttgatcctggctcaggatgaacgctggcggcgtgcttaacacatgcaagtcgaacggagcttagaaggaagcttgctttcatttaagcttagtggcggacgggtgagtaacgcgtgagcaacctgccctcgagtggggaataacatcgagaaatcggtgctaataccgcataatgtcgagagaccgcatgatctttcgaccaaaggatttattcgcttgaggatgggctcgcgtccgattagctagttggtgaggtaacggcccaccaaggcttcgatcggtagccgaactgagaggttgatcggccacattgggactgagacacggcccagactcctacgggaggcagcagtggggaatattgggcaatgggcgaaagcctgacccagcaacgccgcgtgaaggatgaaggtcttcggattgtaaacttctttgattggggaagaataaaatgacctacccaaagaacaagccacggctaactacgtgccagcagccgcggtaatacgtaggtggcaagcgttatccggatttactgggtgtaaagggcgtgtaggcggctctgcaagtcagaagtgaaattcctgggctcaacccgggcgctgcttctgaaactgcagaacttgagtactggaggggaaagcggaattcctagtgtagcggtaaaatgcgcagatattaggaggaacaccggtggcgaaggcggctttctggacagtaactgacgctgaggcgcgaaagcgtggggagcaaacaggattagataccctggtagtccacgccgtaaacgatgaatactaggtgtagggggtatcgactccctctgtgccgcagttaacacattaagtattccacctggggagtacggccgcaaggttgaaactcaaaggaattgacgggggcccgcacaagcagtggattatgtggtttaattcgaagcaacgcgaagaaccttaccagggcttgacatcctctgacagctctagagatagagtctcccttcggggcagagagacaggtggtgcatggttgtcgtcagctcgtgtcgtgagatgtttggttaagtccaataacgagcgcaacccctattgccagttgctaacatttagttgagaactctggcgagactgccgcggacaacgcggaggaaggaggggacgacgtcaaatcatcatgccccttatgtcctgggctacacacgtaatacaatggcaacgacagagggcagctaagccgcgaggccaagcgaatccccaaacgttgtcccagttcggactgcaggctgcaactcgcctgcacgaagtcggaattgctagtaatggcaggtcagcatactgccgtgaatacgttcccgggccttgtacacaccgcccgtcacaccatgagagtctgcaatacccgaagtcagtagtctaaccgcaaggaggacgctgccgaaggtagggccgataattggggtgaagtcgtaacaaggtagccgtatcggaaggtgcggctggatcacctcctttcta

SEQ ID NO: 8016 - DNA, 1540 bp, Ruminococcaceae bacterium AM07-15
  ref <308>: DATABASE ACCESSION NUMBER: NCBI ACCESSION: NZ_QUDE01000020.1
  ref <309>: DATABASE ENTRY DATE: 2019-04-01
  ref <313>: RELEVANT RESIDUES IN SEQ ID NO: (1)..(1540)
tttttagagagtttgatcctggctcaggatgaacgctggcggcatgcctaacacatgcaagtcgaacggagcacccctgacagaggcttcggccaatggaagggaatgcttagtggcggacgggtgagtaacgcgtgaggaacctgcctttcagtgggggataacacatcgaaagatgtgctaataccgcataacatagcgatggggcatcccattgctatcaaagatttattgctgaaagatggcctcgcgtccaattagctagttggtgaggtaacggcccaccaaggcgacgattggtagccggactgagaggttgaacggccacattgggactgagacacggcccagactcctacgggaggcagcagtggggaatattgcacaatgggggaaaccctgatgcagcaatgccgcgtgaaggatgaaggttttcggattgtaaacttcttttgtacgggacgaaacaaatgacggtaccgtaagaataagccacggctaactacgtgccagcagccgcggtaatacgtaggtggcaagcgttatccggatttactgggtgtaaagggcgagtaggcgggattgcaagtcagatgtgaaaactatgggctcaacccatagactgcatttgaaactgtagttcttgagtgatggagaggcaggcggaattcccggtgtagcggtggaatgcgtagatatcgggaggaacaccagtggcgaaggcggcctgctggacattaactgacgctgaggcgcgaaagcgtggggagcaaacaggattagataccctggtagtccacgctgtaaacgatgattactaggtgtggggggtactgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccagggcttgacatcccgctaacgaagtagagatacattaggtgcccttcggggaaagcggagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggtggggacgacgtcaaatcatcatgccctttatgtcctgggctacacacgtactacaatggcggtcatacagagggaagcaaaacagtgatgtggagcaaaaccctaaaagccgtctcagttcagattgcaggctgcaacccgcctgcatgaagtcggaattgctagtaatcgcggatcagcatgccgcggtgaatacgttcccgggccttgtacacaccgcccgtcacaccatgagagtcggaaacacccgaagcctgtagtccaaccgcaaggagggcgcagtcgaaggtgggtctgataattggggtgaagtcgtaacaaggtagccgtatcggaaggtgcggctggatcacctcctttctaagga

SEQ ID NO: 8017 - DNA, 1519 bp, Ruminococcaceae bacterium CPB6
  ref <308>: DATABASE ACCESSION NUMBER: NCBI ACCESSION: NZ_CP020705.1
  ref <309>: DATABASE ENTRY DATE: 2019-04-01
  ref <313>: RELEVANT RESIDUES IN SEQ ID NO: (1)..(1519)
ttttagagagtttgatcctggctcaggacgaacgctggcggcgtgcctaacacatgcaagtcgaacgaaactttttgcttcggtagaaagtttagtggcggacgggtgagtaacgcgtgaggaacctgcctttcagagggggataatgtctggaaacggacactaataccgcatgacattttctgttcacatggacagaaaatcaaaggagcaatctgctgaaagatggactcgcgtccgattagctagatggtgagataatagcccaccatggcgacgatcggtagccggactgagaggttgaacggccacattgggactgagacacggcccagactcctacgggaggcagcagtgggggatattgcacaatggaggaaactctgatgcagcaacgccgcgtgaaggaagacggtcttcggattgtaaacttttgtacctagggacgataatgacggtacctaggcagcaagctccggctaactacgtgccagcagccgcggtaatacgtagggagcgagcgttgtccggatttactgggtgtaaagggtgcgtaggcggccaagcaagtcagctgtgaaaactatgggcttaacccatagcctgcaattgaaactgtttggcttgagtgaagtagaggtaggtggaattcccggtgtagcggtgaaatgcgtagagatcgggaggaacaccagtggcgaaggcgacctactgggctttaactgacgctgaagcacgaaagcatgggtagcaaacaggattagataccctggtagtccatgctgtaaacgatgattactaggtgtggggggtctgaccccttccgtgccggagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatccaactaacgaagcagagatgcattaggtgcccttcggggaaagttgagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggacgacgtcaaatcatcatgccccttatgacctgggctacacacgtactacaatggccgttaacagagagaagcgataccgcgaggtggagcgaacctcaaaaagcggtctcagttcggattgcaggctgaaacccgcctgcatgaagttggaattgctagtaatcgcggatcataatgccgcggtgaatacgttcccgggccttgtacacaccgcccgtcacaccatgggagccggtaatacccgaagtcagtagtctaaccgcaaggaggacgctgccgaaggtaggattggcgactggggtgaagtcgtaacaaggtagccgtatcagaaggtgcggctggatcacctcctttctatgga

SEQ ID NO: 8018 - DNA, 1397 bp, Ruminococcaceae bacterium FB2012
  ref <308>: DATABASE ACCESSION NUMBER: NCBI ACCESSION: NZ_FMXS01000002.1
  ref <309>: DATABASE ENTRY DATE: 2019-04-01
  ref <313>: RELEVANT RESIDUES IN SEQ ID NO: (1)..(1397)
gagcaatctgcctttcagagggggatagcagttggaaacgactgataataccgcataatataacgaagccgcatgactttgttatcaaagatttatcgctgaaagatgagctcgcgtctgattaggtagttggtgaggtaacggctcaccaagccgacgatcagtagccggactgagaggttgaacggccacattgggactgagacacggcccagactcctacgggaggcagcagtggggaatattgcacaatgggcgcaagcctgatgcagcgatgccgcgtgagggaagaaggttttaggattgtaaacctctgtcctatggaaagataatgacggtaccataggaggaagctccggctaactacgtgccagcagccgcggtaatacgtagggagcgagcgttgtccggaattactgggtgtaaagggagtgtaggcgggactgcaagtcagatgtgaaaactatgggcttaacccatagactgcatttgaaactgtagttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgccgtaaacgatgattactaggtgtggggggactgaccccttccgtgccgcagttaacacaataagtaatccacctggggagtacggccgcaaggctgaaactcaaaggaattgacgggggcccgcacaagcagtggagtatgtggattaattcgaagcaacgcgaagaaccttaccaggtcttgacatcgtgagcatagcatagagatatgtgaaatcccttcggggactcatagacaggtggtgcatggttgtcgtcagctcgtgtcgtgagatgttgggttaagtcccgcaacgagcgcaacccttatgtttagttgctacgcaagagcactctaaacagactgccgttgacaaaacggaggaaggtggggatgacgtcaaatcatcatgccccttatgacctgggcctcacacgtactacaatggctatcaacaaagtgaagcgagaccgcgaggtggagcaaaacacaaaaaatagtcttagttcggattgtaggctgcaacccgcctacatgaagtcggaattgctagtaatcgcagatcagcatgctgcggtgaatacgttcccgggccttgtacacaccgcccgtcacaccatgggagtcggtaacacccgaagtcagtagcctaaccgcaaggagggcgctgccgaaggtgggattgatgactggggtgaagtcgtaacaaggtagccgtatcggaaggtgcggctggatcacctcctttctatgga

SEQ ID NO: 8019 - DNA, 1531 bp, Ruminococcaceae bacterium Marseille-P2935
  ref <308>: DATABASE ACCESSION NUMBER: NCBI ACCESSION: NZ_LT629950.1
  ref <309>: DATABASE ENTRY DATE: 2019-04-01
  ref <313>: RELEVANT RESIDUES IN SEQ ID NO: (1)..(1531)
ttgaactaagagtttgatcctggctcaggacgaacgctggcggcacgcctaacacatgcaagtcgaacggagctattttagcggaagccttcgggcagaagctggcttagcttagtggcggacgggtgagtaacacgtgagcaacctgcctttgcgagggggataacgtttggaaacgaacgctaataccgcataatgtcagaaggtcgcatgattttctgaccaaagatttatcgcgcaaagatgggctcgcgtccgattagatagttggtgaggtaacggcccaccaagtctgcgatcggtagccggactgagaggttgaacggccacattgggactgagacacggcccagactcctacgggaggcagcagtgggggatattgcacaatggagggaactctgatgcagcgatgccgcgtgagggaagacggtcttcggattgtaaacctctgtcttcagggacgaacacaatgacggtacctgaggaggaagctccggctaactacgtgccagcagccgcggtaatacgtagggagcaagcgttgtccggaattactgggtgtaaagggagtgtaggcgggtctccaagtccgttgtcaaatctatcggctcaaccgatagccgcggcggaaactggaggtcttgagtgaagtagaggcaggcggaattcctagtgtagcggtgaaatgcgtagatattaggaggaacaccagtggcgaaggcggcctgctgggctttaactgacgctgaggctcgaaagtgtggggagcaaacaggattagataccctggtagtccacactgtaaacgatgattactaggtgtggggggactgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcggatgcataccatagagatatgggaagcccttcggggcatccagacaggtggtgcatggttgtcgtcagctcgtgtcgtgagatgttgggttaagtcccgcaacgagcgcaacccttatccttagttgctacgcaagagcactctaaagagactgccgttgacaaaacggaggaaggtggggatgacgtcaaatcatcatgccccttatgacctgggctacacacgtactacaatggcgattaacaaagggatgcaacacggcgacgtgaagcggaacccaaaaaatcgtctcagttcagattgcaggctgcaacccgcctgcatgaagtcggaattgctagtaatcgcggatcagcatgccgcggtgaatacgttcccgggccttgtacacaccgcccgtcacaccatgggagtcggtaacacccgaagtcagtagcctaaccgcaaggagggcgctgccgaaggtgggattgatgactggggtgaagtcgtaacaaggtagccgtatcggaaggtgcggctggatcacctcctttcta

SEQ ID NO: 8020 - DNA, 1422 bp, Ruminococcaceae bacterium P7
  ref <308>: DATABASE ACCESSION NUMBER: NCBI ACCESSION: NZ_FMUA01000001.1
  ref <309>: DATABASE ENTRY DATE: 2019-04-01
  ref <313>: RELEVANT RESIDUES IN SEQ ID NO: (1)..(1422)
ttttagagagtttgatcctggctcaggacgaacgctggcggcgtgcctaacacatgcaagtcgaacggagttgaggagcttgctccttaacttagtggcggacgggtgagtaacgcgtgagtaacctgcctctgagaggggaataacgttctgaaaagaacgctaataccgcatgacacatatttgccgcatgacagatatgtcaaagattttatcgctcagagatggactcgcgtccgattagttagttggtgaggtaacggctcaccaagaccgcgatcggtagccggactgagaggttgaacggccacattgggactgagacacggcccagactcctacgggaggcagcagtgggggatattgcgcaatgggggcaaccctgacgcagcaacgccgcgtgaaggatgaaggttttcggattgtaaacttcttttctcagggacgaaatttgacggtacctgaggaataagctccggctaactacgtgccagcagccgcggtaatacgtagggagcaagcgttgtccggatttactgggtgtaaagggtgcgtaggcggctttgtaagtcagatgtgaaatctatgggctcaacccataaactgcatttgaaactacagagcttgagtgaagtagaggcaggcggaattccctgtgtagcggtgaaatgcgtagagatagggaggaacaccagtggcgaaggcggcctgctgggctttaactgacgctgaggcacgaaagcgtgggtagcaaacaggattagataccctggtagtccacgctgtaaacgatgattactaggtgtggggggactgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccgactaacgaagtagagatacatcaggtgcccttcggggaaagtcgagacaggtggtgcatggttgtcgtcagctcgtgtcgtgagatgttgggttaagtcccgcaacgagcgcaacccttgctattagttgctacgcaagagcactctaataggactgccgttgacaaaacggaggaaggtggggacgacgtcaaatcatcatgccccttatgacctgggctacacacgtactacaatggccatcaacagagggaagcaaaacagcgatgtggagcaaacccctaaaaatggtctcagttcagattgcaggctgcaacccgcctgcatgaagtcggaattgctagtaatcgcggatcagcatgccgcggtgaatacgttcccgggccttgtacacaccgcccgtcacaccatgggagccggtaatacccgaagtcagtagcttaacctcg

SEQ ID NO: 8021 - DNA, 1532 bp, Ruminococcaceae bacterium R-25
  ref <308>: DATABASE ACCESSION NUMBER: NCBI ACCESSION: NZ_QGFZ01000003.1
  ref <309>: DATABASE ENTRY DATE: 2019-04-01
  ref <313>: RELEVANT RESIDUES IN SEQ ID NO: (1)..(1532)
tttgttgagagttcgatcctggctcaggatgaacgctggcggcgtgcttaacacatgcaagtcgaacggggtttaagaaggaagcttgctttcattttaaacctagtggcggacgggtgagtaacgcgtgaggaacctgcccttcagtggggaacaacaactagaaatggttgctaataccgcataatgtcggagagccgcatgacattccgaccaaaggatttattcgctgaaggatggcctcgcgtccgattagatagttggtgaggtaacggcccaccaagtctacgatcggtagccgaactgagaggttgatcggccacattgggactgagacacggcccagactcctacgggaggcagcagtggggaatattgggcaatgggcgaaagcctgacccagcaacgccgcgtgaaggatgacggtcttcggattgtaaacttctttaattggggaagaacaaaatgacctacccaaagaataagtcacggctaactacgtgccagcagccgcggtaatacgtaggtgacaagcgttatccggatttactgggcgtaaagggcgtgtaggcggtcttgcaagtcagaagtgaaattcctgagctcaactcgggcgctgcttctgaaactgcaggacttgagtgctggaggggatagcggaattcctagtggagcggtaaaatgcgcagatattaggaagaacaccggtggcgaaggcggctatctggacagtaactgacgctgaggcgcgaaagcgtggggagcaaacaggattagataccctggtagtccacgccgtaaacgatgaatactaggtgtagggggtatcgactccctctgtgccgcagttaacacaataagtattccgcctggggagtacggccgcaaggttgaaactcaaaggaattgacgggggcccgcacaagcagtggattatgtggtttaattcgaagcaacgcgaagaaccttaccagggcttgacatcctctgaccgctctagagatagagtttcccttcggggcagagagacaggtggtgcatggttgtcgtcagctcgtgtcgtgagatgtttggttaagtccaataacgagcgcaacccctatggtcagttgccatcatttagttgggcactctggcaagactgccgcggacaacgcggaggaaggaggggacgacgtcaaatcatcatgccccttatgtcctgggctacacacgtaatacaatggcaacgacagagggcagcaaacccgcgagggcaagcaaatccccaaacgttgtctcagttcggactgcaggctgcaacccgcctgcacgaagtcggaattgctagtaatggcaggtcagcatactgccgtgaatacgttcccgggccttgtacacaccgcccgtcacaccatgagagtctgcaatacccgaagtcagtagcctaaccgcaaggagggcgctgccgaaggtagggccgataattggggtgaagtcgtaacaaggtagccgtatcggaaggtgcggctggatcacctcctttctaagga

SEQ ID NO: 8022 - DNA, 1532 bp, Ruminococcaceae bacterium cv2
  ref <308>: DATABASE ACCESSION NUMBER: NCBI ACCESSION: NZ_LN877904.1
  ref <309>: DATABASE ENTRY DATE: 2019-04-01
  ref <313>: RELEVANT RESIDUES IN SEQ ID NO: (1)..(1532)
tttaatgaagagtttgatcctggctcaggacgaacgctggcggcgcgcctaacacatgcaagtcgaacggagctgttttctctgaagttttcggatggaagagagttcagcttagtggcgaacgggtgagtaacacgtgagcaacctgcctttcagtgggggacaacatttggaaacgaatgctaataccgcataagaccacagtgtcgcatggcacaggggtcaaaggatttatccgctgaaagatgggctcgcgtccgattagctagatggtgaggtaacggcccaccatggcgacgatcggtagccggactgagaggttgaacggccacattgggactgagacacggcccagactcctacgggaggcagcagtggggaatattgcacaatgggggaaaccctgatgcagcgacgccgcgtggaggaagaaggtcttcggattgtaaactcctgtcccaggggacgataatgacggtaccctgggaggaagcaccggctaactacgtgccagcagccgcggtaaaacgtagggtgcaagcgttgtccggaattactgggtgtaaagggagcgcaggcggattgacaagttgggagtgaaatctatgggctcaacccataaattgctttcaaaactgtcagtcttgagtggtgtagaggtaggcggaattcccggtgtagcggtggaatgcgtagatatcgggaggaacaccagtggcgaaggcggcctactgggcactaactgacgctgaggctcgaaagcatgggtagcaaacaggattagataccctggtagtccatgccgtaaacgatgattactaggtgtgggaggattgaccccttccgtgccgcagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatcggatgcatacctaagagattagggaagtccttcgggacatccagacaggtggtgcatggttgtcgtcagctcgtgtcgtgagatgttgggttaagtcccgcaacgagcgcaacccttatcgttagttactacgcaagaggactctagcgagactgccgttgacaaaacggaggaaggtggggatgacgtcaaatcatcatgccctttatgacctgggctacacacgtactacaatggctattaacagagagaagcgataccgcgaggtggagcaaacctcacaaaaatagtctcagttcggatcgcaggctgcaacccgcctgcgtgaagccggaattgctagtaatcgcggatcagcatgccgcggtgaatacgttcccgggccttgtacacaccgcccgtcacaccatgagagccggggggacccgaagtcggtagtctaaccgtaaggaggacgccgccgaaggtaaaactggtgattggggtgaagtcgtaacaaggtagccgtatcggaaggtgcggctggatcacctcctttcta

SEQ ID NO: 8023 - DNA, 1516 bp, Ruminococcus bicirculans
  ref <308>: DATABASE ACCESSION NUMBER: NCBI ACCESSION: NZ_HF545616.1
  ref <309>: DATABASE ENTRY DATE: 2019-04-01
  ref <313>: RELEVANT RESIDUES IN SEQ ID NO: (1)..(1516)
tttaattaagagtttgatcctggctcaggacgaacgctggcggcacgcttaacacatgcaagtcgaacgagagaagaggagcttgcttttctgatctagtggcggacgggtgagtaacacgtgagcaatctgcctttcagagggggataccgattggaaacgatcgttaataccgcataacataattgaaccgcatgatttgattatcaaagatttatcgctgaaagatgagctcgcgtctgattagctagttggtaaggtaacggcttaccaaggcgacgatcagtagccggactgagaggttgatcggccacattgggactgagacacggcccagactcctacgggaggcagcagtggggaatattgcacaatggaggaaactctgatgcagcgatgccgcgtgagggaagaaggttttaggattgtaaacctctgtcttcagggacgaaaaaagacggtacctgaggaggaagctccggctaactacgtgccagcagccgcggtaatacgtagggagcgagcgttgtccggaattactgggtgtaaagggagcgtaggcgggatcgcaagtcagatgtgaaaactatgggcttaacccataaactgcatttgaaactgtggttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgccgtaaacgatgattactaggtgtggggggactgaccccttccgtgccgcagcaaacgcaataagtaatccacctggggagtacgaccgcaaggttgaaactcaaaggaattgacgggggcccgcacaagcagtggagtatgtggattaattcgaagcaacgcgaagaaccttaccaggtcttgacatcgtatgcatagctcagagatgagtgaaatctcttcggagacatatagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggcctcacacgtactacaatggctgtcaacagagggaagcaaagccgcgaggtggagcgaacccctaaaagcagtcttagttcggattgtaggctgcaacccgcctacatgaagtcggaattgctagtaatcgcagatcagcatgctgcggtgaatacgttcccgggccttgtacacaccgcccgtcacgccatgggagtcggtaacacccgaagcctgtagtctaaccgcaaggaggacgcagtcgaaggtgggattgatgactggggtgaagtcgtaacaaggtagccgtatcggaaggtgcggctggatcacctcctttcta

SEQ ID NO: 8024 - DNA, 1320 bp, Ruminococcus bromii
  ref <308>: DATABASE ACCESSION NUMBER: NCBI ACCESSION: NZ_OLKO01000008.1
  ref <309>: DATABASE ENTRY DATE: 2019-04-01
  ref <313>: RELEVANT RESIDUES IN SEQ ID NO: (1)..(1320)
gatatcaaagattttatcgcttgaagatggactcgcgtccgattagttagttggtgaggtaacggctcaccaagaccgcgatcggtagccggactgagaggttgaacggccacattgggactgagacacggcccagactcctacgggaggcagcagtgggggatattgcgcaatgggggcaaccctgacgcagcaacgccgcgtgaaggatgaaggttttcggattgtaaacttcttttattaaggacgaaacttgacggtacttaatgaataagctccggctaactacgtgccagcagccgcggtaatacgtagggagcaagcgttgtccggatttactgggtgtaaagggtgcgtaggcggctttgcaagtcagatgtgaaatctatgggctcaacccataaactgcatttgaaactgtagagcttgagtgaagtagaggcaggcggaattccccgtgtagcggtgaaatgcgtagagatggggaggaacaccagtggcgaaggcggcctgctgggctttaactgacgctgaggcacgaaagcgtgggtagcaaacaggattagataccctggtagtccacgctgtaaacgatgattactaggtgtggggggtctgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccaactaacgaagtagagatacattaggtgcccttcggggaaagttgagacaggtggtgcatggttgtcgtcagctcgtgtcgtgagatgttgggttaagtcccgcaacgagcgcaacccttgctattagttgctacgcaagagcactctaataggactgccgttgacaaaacggaggaaggtggggacgacgtcaaatcatcatgccccttatgacctgggctacacacgtactacaatggatgttaacagagggaagcaagacagcgatgtggagcaaacccctaaaaacattctcagttcagattgcaggctgcaacccgcctgcatgaagatggaattgctagtaatcgcggatcagcatgccgcggtgaatacgttcccgggccttgtacacaccgcccgtcacaccatgggagccggtaatacccgaagtcagtagtccaacctcgtgaggacgctgccgaaggtaggattggcgactggggtgaagtcgtaacaaggtagccgtatcggaaggtgcggctggatcacctcctttctatgga

SEQ ID NO: 8025 - DNA, 1517 bp, Ruminococcus callidus
  ref <308>: DATABASE ACCESSION NUMBER: NCBI ACCESSION: NZ_KI260393.1
  ref <309>: DATABASE ENTRY DATE: 2019-04-01
  ref <313>: RELEVANT RESIDUES IN SEQ ID NO: (1)..(1517)
ttaaataaagagtttgatcctggctcaggacgaacgctggcggcacgcttaacacatgcaagtcgaacggagaacattgagcttgcttaatgttcttagtggcggacgggtgagtaacacgtgagtaacctgcctctgagagtgggatagcttctggaaacggatggtaataccgcataacatcatggattcgcatgtttctgtgatcaaagatttatcgcttagagatggactcgcgtctgattagctagttggtaaggtaacggcttaccaaggcgacgatcagtagccggactgagaggttgatcggccacattgggactgagacacggcccagactcctacgggaggcagcagtggggaatattgcacaatgggggaaaccctgatgcagcgatgccgcgtggaggaagaaggttttcggattgtaaactcctgttgaagaggacgataatgacggtactcttttagaaagctccggctaactacgtgccagcagccgcggtaatacgtagggagcgagcgttgtccggaattactgggtgtaaagggagcgtaggcgggatggcaagtcagatgtgaaaactatgggctcaacccatagactgcatttgaaactgttgttcttgagtgaggtagaggtaagcggaattcctggtgtagcggtgaaatgcgtagagatcaggaggaacatcggtggcgaaggcggcttactgggcctttactgacgctgaggctcgaaagcgtggggagcaaacaggattagataccctggtagtccacgccgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcgagtgacgtacctagagataggtattttcttcggaacacaaagacaggtggtgcatggttgtcgtcagctcgtgtcgtgagatgttgggttaagtcccgcaacgagcgcaacccttaccattagttgctacgcaagagcactctaatgggactgccgttgacaaaacggaggaaggtggggatgacgtcaaatcatcatgccccttatgacctgggctacacacgtactacaatggcaatataacagagggaagcaatacagcgatgtggagcaaatccccaaaaattgtcccagttcagattgcaggctgcaactcgcctgcatgaagtcggaattgctagtaatcgcagatcagcatgctgcggtgaatacgttcccgggccttgtacacaccgcccgtcacaccatgggagtcggtaacacccaaagccggtcgtctaaccttcgggaggatgccgtctaaggtgggattgatgactggggtgaagtcgtaacaaggtagccgtatcggaaggtgcggctggatcacctcctttctaagga

SEQ ID NO: 8026 - DNA, 1560 bp, Ruminococcus faecis
  ref <308>: DATABASE ACCESSION NUMBER: NCBI ACCESSION: NZ_BBDW01000030.1
  ref <309>: DATABASE ENTRY DATE: 2019-04-01
  ref <313>: RELEVANT RESIDUES IN SEQ ID NO: (1)..(1560)
tttaacgagagtttgatcctggctcaggatgaacgctggcggcgtgcttaacacatgcaagtcgaacgaagcaccttgatttgattcttcggatgaagatcttggtgactgagtggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattaggtagttggtgggggggtaacggcctaccaagccgacgatcagtagccgacctgagagggtgaccggccacattgggactgagacacggcccaaactcctacgggaggcagcagtgggggggaatattgcacaatggggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagtggcaagtctgatgtgaaaacccgggctcaaccccccgggactgcattggaaactgtcaatctagagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggggagtacgttcgcaagaatgaaactcaaaggaattgacgggggggacccgcacaagcggtggagcatgtggtttaattcgaagcaacgcgaagaaccttacctgctcttgacatctccctgaccggcaagtaatgttgcctttccttcgggacagggatgacaggtggtgcatggttgtcgtcagctcgtgtcgtgagatgttgggttaagtcccgcaacgagcgcaaccccctatctttagtagccagcggtttggccgggcactctagagagactgccagggataacctggaggaaggtgggggggatgacgtcaaatcatcatgcccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactgggggggtgaagtcgtaacaaggtagccgtatcggaaggtgcggctggatcacctcctttctaaggaa

SEQ ID NO: 8027 - DNA, 1539 bp, Ruminococcus lactaris
  ref <308>: DATABASE ACCESSION NUMBER: NCBI ACCESSION: NZ_QRMI01000006.1
  ref <309>: DATABASE ENTRY DATE: 2019-04-01
  ref <313>: RELEVANT RESIDUES IN SEQ ID NO: (1)..(1539)
tttaacgagagtttgatcctggctcaggatgaacgctggcggcgtgcttaacacatgcaagtcgagcgaagcacttaggaaagattcttcggatgatttcctatttgactgagcggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattagttagttggtggggtaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggagcagcaagtctgatgtgaaaacccggggctcaaccccgggactgcattggaaactgttgatctggagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggtggcaaagccattcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccggtgacggcagagtaatgtctgcttttcttcggaacaccggtgacaggtggtgcatggttgtcgtcagctcgtgtcgtgagatgttgggttaagtcccgcaacgagcgcaacccctatcttcagtagccagcggtaaggccgggcactctggagagactgccagggataacctggaggaaggtggggatgacgtcaaatcatcatgccccttatgagcagggctacacacgtgctacaatggcgtaaacaaagggaagcgaacccgcgagggtgggcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 8028 - DNA, 1540 bp, Ruminococcus sp. 5 1 39BFAA
  ref <308>: DATABASE ACCESSION NUMBER: NCBI ACCESSION: NZ_ACII02000003.1
  ref <309>: DATABASE ENTRY DATE: 2019-04-01
  ref <313>: RELEVANT RESIDUES IN SEQ ID NO: (1)..(1540)
tttatcagagagtttgatcctggctcaggatgaacgctggcggcgtgcttaacacatgcaagtcgaacgggaattactttattgaaacttcggtcgatttaatttaattctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagctagttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcagagccattcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgactgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatggggagtcagtaacgcccgaagtcagtgacctaaccgaaagggaggagctgccgaaggcgggaccgatgactggggtgaagtcgtaacaaggtagccgtatcggaaggtgcggctggatcacctcctttctaaggaa

SEQ ID NO: 8029 - DNA, 1526 bp, Ruminococcus sp. AF12-5
  ref <308>: DATABASE ACCESSION NUMBER: NCBI ACCESSION: NZ_QTXN01000008.1
  ref <309>: DATABASE ENTRY DATE: 2019-04-01
  ref <313>: RELEVANT RESIDUES IN SEQ ID NO: (1)..(1526)
atcctggctcaggatgaacgctggcggcgtgcttaacacatgcaagtcgaacgaagcacttttatttgatttcttcggaatgaagattttagtgactgagtggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagtggcaagtctgatgtgaaaacccggggctcaaccccgggactgcattggaaactgtcaatctagagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttccttcgggacagggatgacaggtggtgcatggttgtcgtcagctcgtgtcgtgagatgttgggttaagtcccgcaacgagcgcaacccctatctttagtagccagcggtcaggccgggcactctagagagactgccagggataacctggaggaaggtggggatgacgtcaaatcatcatgccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 8030 - DNA, 1540 bp, Ruminococcus sp. AF13-28
  ref <308>: DATABASE ACCESSION NUMBER: NCBI ACCESSION: NZ_QRZZ01000016.1
  ref <309>: DATABASE ENTRY DATE: 2019-04-01
  ref <313>: RELEVANT RESIDUES IN SEQ ID NO: (1)..(1540)
tttatcagagagtttgatcctggctcaggatgaacgctggcggcgtgcttaacacatgcaagtcgaacgggaaatacttcattgagacttcggtggatttgatttatttctagtggcggacgggtgagtaacgcgtgggtaacctgccttatacagggggataacagtcagaaatgactgctaataccgcataagcgcacaggaccgcatggtccggtgtgaaaaactccggtggtataagatggacccgcgttggattagctggttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcatggccattcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgactcttaaccgagtctttccttcgggacagaggagacaggtggtgcatggttgtcgtcagctcgtgtcgtgagatgttgggttaagtcccgcaacgagcgcaacccctatcctcagtagccagcaagttaagttgggcactctgtggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctcctttctaaggaa

SEQ ID NO: 8031 - DNA, 1540 bp, Ruminococcus sp. AF13-37; identical to SEQ ID NO: 8030
  ref <308>: DATABASE ACCESSION NUMBER: NCBI ACCESSION: NZ_QRZX01000005.1
  ref <309>: DATABASE ENTRY DATE: 2019-04-01
  ref <313>: RELEVANT RESIDUES IN SEQ ID NO: (1)..(1540)

SEQ ID NO: 8032 - DNA, 1539 bp, Ruminococcus sp. AF14-5
  ref <308>: DATABASE ACCESSION NUMBER: NCBI ACCESSION: NZ_QUHI01000026.1
  ref <309>: DATABASE ENTRY DATE: 2019-04-01
  ref <313>: RELEVANT RESIDUES IN SEQ ID NO: (1)..(1539)
tttatcagagagtttgatcctggctcaggatgaacgctggcggcgtgcttaacacatgcaagtcgaacgggaaatatttcattgagacttcggtggatttgatttatttctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcaaagctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctcctttctaaggaa

SEQ ID NO: 8033 - DNA, 1539 bp, Ruminococcus sp. AF16-40
  ref <308>: DATABASE ACCESSION NUMBER: NCBI ACCESSION: NZ_QTXF01000010.1
  ref <309>: DATABASE ENTRY DATE: 2019-04-01
  ref <313>: RELEVANT RESIDUES IN SEQ ID NO: (1)..(1539)
aaattttagagagtttgatcctggctcaggacgaacgctggcggcgtgcctaacacatgcaagtcgaacggaactgttttgaaagatttcttcggaatgaatttgatttagtttagtggcggacgggtgagtaacgcgtgagtaacctgccttcaagagggggataacattctgaaaagaatgctaataccgcatgacatatcggaaccacatggttttgatatcaaagattttatcgcttgaagatggactcgcgtccgattagttagttggtgaggtaacggctcaccaagaccgcgatcggtagccggactgagaggttgaacggccacattgggactgagacacggcccagactcctacgggaggcagcagtgggggatattgcgcaatgggggcaaccctgacgcagcaacgccgcgtgaaggatgaaggttttcggattgtaaacttcttttattaaggacgaaaaatgacggtacttaatgaataagctccggctaactacgtgccagcagccgcggtaatacgtagggagcaagcgttgtccggatttactgggtgtaaagggtgcgtaggcggctttgcaagtcagatgtgaaatctatgggctcaacccataaactgcatttgaaactgtagagcttgagtgaagtagaggcaggcggaattccccgtgtagcggtgaaatgcgtagagatggggaggaacaccagtggcgaaggcggcctgctgggctttaactgacgctgaggcacgaaagcgtgggtagcaaacaggattagataccctggtagtccacgctgtaaacgatgattactaggtgtggggggtctgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccaactaacgaagtagagatacattaggtgcccttcggggaaagttgagacaggtggtgcatggttgtcgtcagctcgtgtcgtgagatgttgggttaagtcccgcaacgagcgcaacccttgctattagttgctacgcaagagcactctaataggactgccgttgacaaaacggaggaaggtggggacgacgtcaaatcatcatgccccttatgacctgggctacacacgtactacaatggatgttaacagagggaagcaagacagtgatgtggagcaaacccctaaaaacattctcagttcagattgcaggctgcaacccgcctgcatgaagatggaattgctagtaatcgcggatcagcatgccgcggtgaatacgttcccgggccttgtacacaccgcccgtcacaccatgggagccggtaatacccgaagtcagtagtccaacctcgtgaggacgctgccgaaggtaggattggcgactggggtgaagtcgtaacaaggtagccgtatcggaaggtgcggctggatcacctcctttctatgga

SEQ ID NO: 8034 - DNA, 1539 bp, Ruminococcus sp. AF17-11
  ref <308>: DATABASE ACCESSION NUMBER: NCBI ACCESSION: NZ_QTXC01000012.1
  ref <309>: DATABASE ENTRY DATE: 2019-04-01
  ref <313>: RELEVANT RESIDUES IN SEQ ID NO: (1)..(1539)
aaattttagagagtttgatcctggctcaggacgaacgctggcggcgtgcctaacacatgcaagtcgaacggaactgttttgaaagatttcttcggaatgaatttgatttagtttagtggcggacgggtgagtaacgcgtgagtaacctgccttcaagagggggataacattctgaaaagaatgctaataccgcatgacatatcggaaccacatggttctgatatcaaagattttatcgcttgaagatggactcgcgtccgattagttagttggtgaggtaacggctcaccaagaccgcgatcggtagccggactgagaggttgaacggccacattgggactgagacacggcccagactcctacgggaggcagcagtgggggatattgcgcaatgggggcaaccctgacgcagcaacgccgcgtgaaggatgaaggttttcggattgtaaacttcttttattaaggacgaaaattgacggtacttaatgaataagctccggctaactacgtgccagcagccgcggtaatacgtagggagcaagcgttgtccggatttactgggtgtaaagggtgcgtaggcggctttgcaagtcagatgtgaaatctatgggctcaacccataaactgcatttgaaactgtagagcttgagtgaagtagaggcaggcggaattccccgtgtagcggtgaaatgcgtagagatggggaggaacaccagtggcgaaggcggcctgctgggctttaactgacgctgaggcacgaaagcgtgggtagcaaacaggattagataccctggtagtccacgctgtaaacgatgattactaggtgtggggggtctgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccaactaacgaagtagagatacattaggtgcccttcggggaaagttgagacaggtggtgcatggttgtcgtcagctcgtgtcgtgagatgttgggttaagtcccgcaacgagcgcaacccttgctattagttgctacgcaagagcactctaataggactgccgttgacaaaacggaggaaggtggggacgacgtcaaatcatcatgccccttatgacctgggctacacacgtactacaatggatgttaacagagggaagcaagacagcgatgtggagcaaacccctaaaaacattctcagttcagattgcaggctgcaacccgcctgcatgaagatggaattgctagtaatcgcggatcagcatgccgcggtgaatacgttcccgggccttgtacacaccgcccgtcacaccatgggagccggtaatacccgaagtcagtagtccaacctcgtgaggacgctgccgaaggtaggattggcgactggggtgaagtcgtaacaaggtagccgtatcggaaggtgcggctggatcacctcctttctatgga

SEQ ID NO: 8035 - DNA, 1516 bp, Ruminococcus sp. AF17-1AC
  ref <308>: DATABASE ACCESSION NUMBER: NCBI ACCESSION: NZ_QTWZ01000006.1
  ref <309>: DATABASE ENTRY DATE: 2019-04-01
  ref <313>: RELEVANT RESIDUES IN SEQ ID NO: (1)..(1516)
tttaattaagagtttgatcctggctcaggacgaacgctggcggcacgcttaacacatgcaagtcgaacgagagaagagaagcttgcttttctgatctagtggcggacgggtgagtaacacgtgagcaatctgcctttcagagggggataccgattggaaacgatcgttaataccgcataatataattgaaccgcatgatttgattatcaaagatttatcgctgaaagatgagctcgcgtctgattagctagttggtaaggtaacggcttaccaaggcgacgatcagtagccggactgagaggttgatcggccacattgggactgagacacggcccagactcctacgggaggcagcagtggggaatattgcacaatggaggaaactctgatgcagcgatgccgcgtgagggaagaaggttttaggattgtaaacctctgtcttcagggacgaaaaaagacggtacctgaggaggaagctccggctaactacgtgccagcagccgcggtaatacgtagggagcgagcgttgtccggaattactgggtgtaaagggagcgtaggcgggatcgcaagtcagatgtgaaaactatgggcttaacccataaactgcatttgaaactgtggttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgccgtaaacgatgattactaggtgtggggggactgaccccttccgtgccgcagcaaacgcaataagtaatccacctggggagtacgaccgcaaggttgaaactcaaaggaattgacgggggcccgcacaagcagtggagtatgtggattaattcgaagcaacgcgaagaaccttaccaggtcttgacatcgtatgcatagctcagagatgagtgaaatctcttcggagacatatagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggcctcacacgtactacaatggctgtaaacagagggatgcaaagccgcgaggtggagcgaacccctaaaagcagtcttagttcggattgtaggctgcaacccgcctacatgaagtcggaattgctagtaatcgcagatcagcatgctgcggtgaatacgttcccgggccttgtacacaccgcccgtcacgccatgggagtcggtaacacccgaagcctgtagtctaaccgcaaggaggacgcagtcgaaggtgggattgatgactggggtgaagtcgtaacaaggtagccgtatcggaaggtgcggctggatcacctcctttcta

SEQ ID NO: 8036 - DNA, 1516 bp, Ruminococcus sp. AF17-24; identical to SEQ ID NO: 8035
  ref <308>: DATABASE ACCESSION NUMBER: NCBI ACCESSION: NZ_QTWX01000005.1
  ref <309>: DATABASE ENTRY DATE: 2019-04-01
  ref <313>: RELEVANT RESIDUES IN SEQ ID NO: (1)..(1516)

SEQ ID NO: 8037 - DNA, 1516 bp, Ruminococcus sp. AF17-6; identical to SEQ ID NO: 8035
  ref <308>: DATABASE ACCESSION NUMBER: NCBI ACCESSION: NZ_QTWW01000002.1
  ref <309>: DATABASE ENTRY DATE: 2019-04-01
  ref <313>: RELEVANT RESIDUES IN SEQ ID NO: (1)..(1516)

SEQ ID NO: 8038 - DNA, 1516 bp, Ruminococcus sp. AF17-6LB; identical to SEQ ID NO: 8035
  ref <308>: DATABASE ACCESSION NUMBER: NCBI ACCESSION: NZ_QTWV01000002.1
  ref <309>: DATABASE ENTRY DATE: 2019-04-01
  ref <313>: RELEVANT RESIDUES IN SEQ ID NO: (1)..(1516)

SEQ ID NO: 8039 - DNA, 1516 bp, Ruminococcus sp. AF18-29
  ref <308>: DATABASE ACCESSION NUMBER: NCBI ACCESSION: NZ_QTWT01000001.1
  ref <309>: DATABASE ENTRY DATE: 2019-04-01
  ref <313>: RELEVANT RESIDUES IN SEQ ID NO: (1)..(1516)
tttaattaagagtttgatcctggctcaggacgaacgctggcggcacgcttaacacatgcaagtcgaacgagagaagagaagcttgcttttctgatctagtggcggacgggtgagtaacacgtgagcaatctgcctttcagagggggataccgattggaaacgatcgttaataccgcataacataattgaaccgcatgatttgattatcaaagatttatcgctgaaagatgagctcgcgtctgattagctagttggtaaggtaacggcttaccaaggcgacgatcagtagccggactgagaggttgatcggccacattgggactgagacacggcccagactcctacgggaggcagcagtggggaatattgcacaatggaggaaactctgatgcagcgatgccgcgtgagggaagaaggttttaggattgtaaacctctgtcttcagggacgaaaaaagacggtacctgaggaggaagctccggctaactacgtgccagcagccgcggtaatacgtagggagcgagcgttgtccggaattactgggtgtaaagggagcgtaggcgggatcgcaagtcagatgtgaaaactatgggcttaacccataaactgcatttgaaactgtggttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgccgtaaacgatgattactaggtgtggggggactgaccccttccgtgccgcagcaaacgcaataagtaatccacctggggagtacgaccgcaaggttgaaactcaaaggaattgacgggggcccgcacaagcagtggagtatgtggattaattcgaagcaacgcgaagaaccttaccaggtcttgacatcgtatgcatagctcagagatgagtgaaatctcttcggagacatatagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggcctcacacgtactacaatggctgtaaacagagggatgcaaagccgcgaggtggagcgaacccctaaaagcagtcttagttcggattgtaggctgcaacccgcctacatgaagtcggaattgctagtaatcgcagatcagcatgctgcggtgaatacgttcccgggccttgtacacaccgcccgtcacgccatgggagtcggtaacacccgaagcctgtagtctaaccgcaaggaggacgcagtcgaaggtgggattgatgactggggtgaagtcgtaacaaggtagccgtatcggaaggtgcggctggatcacctcctttcta

SEQ ID NO: 8040 - DNA, 1516 bp, Ruminococcus sp. AF19-15
  ref <308>: DATABASE ACCESSION NUMBER: NCBI ACCESSION: NZ_QTWR01000007.1
  ref <309>: DATABASE ENTRY DATE: 2019-04-01
  ref <313>: RELEVANT RESIDUES IN SEQ ID NO: (1)..(1516)
tttaattaagagtttgatcctggctcaggacgaacgctggcggcacgcttaacacatgcaagtcgaacgagagaagagaagcttgcttttctgatctagtggcggacgggtgagtaacacgtgagcaatctgcctttcagagggggataccgattggaaacgatcgttaataccgcataacataattgaaccgcatgatttgattatcaaagatttatcgctgaaagatgagctcgcgtctgattagctagttggtaaggtaacggcttaccaaggcgacgatcagtagccggactgagaggttgatcggccacattgggactgagacacggcccagactcctacgggaggcagcagtggggaatattgcacaatggaggaaactctgatgcagcgatgccgcgtgagggaagaaggttttaggattgtaaacctctgtcttcagggacgaaaaaagacggtacctgaggaggaagctccggctaactacgtgccagcagccgcggtaatacgtagggagcgagcgttgtccggaattactgggtgtaaagggagcgtaggcgggatcgcaagtcagatgtgaaaactatgggcttaacccataaactgcatttgaaactgtggttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgccgtaaacgatgattactaggtgtggggggactgaccccttccgtgccgcagcaaacgcaataagtaatccacctggggagtacgaccgcaaggttgaaactcaaaggaattgacgggggcccgcacaagcagtggagtatgtggattaattcgaagcaacgcgaagaaccttaccaggtcttgacatcgtatgcatagctcagagatgagtgaaatctcttcggagacatatagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggcctcacacgtactacaatggctgttaacagagggatgcaaagccgcgaggtggagcgaacccctaaaagcagtcttagttcggattgtaggctgcaacccgcctacatgaagtcggaattgctagtaatcgcagatcagcatgctgcggtgaatacgttcccgggccttgtacacaccgcccgtcacgccatgggagtcggtaacacccgaagcctgtagtctaaccgcaaggaggacgcagtcgaaggtgggattgatgactggggtgaagtcgtaacaaggtagccgtatcggaaggtgcggctggatcacctcctttcta

SEQ ID NO: 8041 - DNA, 1539 bp, Ruminococcus sp. AF19-29
  ref <308>: DATABASE ACCESSION NUMBER: NCBI ACCESSION: NZ_QUGM01000008.1
  ref <309>: DATABASE ENTRY DATE: 2019-04-01
  ref <313>: RELEVANT RESIDUES IN SEQ ID NO: (1)..(1539)
ttaatcagagagtttgatcctggctcaggatgaacgctggcggcgtgcttaacacatgcaagtcgaacgggaattactttattgaaacttcggtcgatttaatttaattctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctcctttctaaggaa

SEQ ID NO: 8042 - DNA, 1539 bp, Ruminococcus sp. AF19-4LB
  ref <308>: DATABASE ACCESSION NUMBER: NCBI ACCESSION: NZ_QTWQ01000009.1
  ref <309>: DATABASE ENTRY DATE: 2019-04-01
  ref <313>: RELEVANT RESIDUES IN SEQ ID NO: (1)..(1539)
tttaacgagagtttgatcctggctcaggatgaacgctggcggcgtgcttaacacatgcaagtcgaacgaagcaccttgatttgattcttcggatgaagatcttggtgactgagtggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagtggcaagtctgatgtgaaaacccggggctcaaccccgggactgcattggaaactgtcaatctagagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttcctttgggacagggatgacaggtggtgcatggttgtcgtcagctcgtgtcgtgagatgttgggttaagtcccgcaacgagcgcaacccctatctttagtagccagcggttcggccgggcactctagagagactgccagggataacctggaggaaggtggggatgacgtcaaatcatcatgccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 8043 - DNA, 1427 bp, Ruminococcus sp. AF20-12LB
  ref <308>: DATABASE ACCESSION NUMBER: NCBI ACCESSION: NZ_QUGH01000030.1
  ref <309>: DATABASE ENTRY DATE: 2019-04-01
  ref <313>: RELEVANT RESIDUES IN SEQ ID NO: (1)..(1427)
ttctagtggcggacgggtgagtaacgcgtgggtaacctgccttgtacagggggataacagtcagaaatgactgctaataccgcataagcgcacagagctgcatggctcagtgtgaaaaactccggtggtataagatggacccgcgttggattagctagttggtgaggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggatggacaagtctgatgtgaaaggctggggctcaaccccgggactgcattggaaactgcccgtcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgcggtaaacgatgaatgctaggtgtcgggaagcaaagcttttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaagtcttgacatccctctgaccgactcttaaccgagtctttccttcgggacagaggagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgaacccgcgagggtgggcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaaccgcaaggaaggagctgccgaaggcgggaccgatgactggggtgaagtcgtaacaaggtagccgtatcggaaggtgcggctggatcacctcctttcta

SEQ ID NO: 8044 - DNA, 1516 bp, Ruminococcus sp. AF21-11
  ref <308>: DATABASE ACCESSION NUMBER: NCBI ACCESSION: NZ_QTWO01000015.1
  ref <309>: DATABASE ENTRY DATE: 2019-04-01
  ref <313>: RELEVANT RESIDUES IN SEQ ID NO: (1)..(1516)
tttaattaagagtttgatcctggctcaggacgaacgctggcggcacgcttaacacatgcaagtcgaacgagagaagaggagcttgcttttctgatctagtggcggacgggtgagtaacacgtgagcaatctgcctttcagagggggataccgattggaaacgatcgttaataccgcataatataattgaaccgcatgatttgattatcaaagatttatcgctgaaagatgagctcgcgtctgattagctagttggtaaggtaacggcttaccaaggcgacgatcagtagccggactgagaggttgatcggccacattgggactgagacacggcccagactcctacgggaggcagcagtggggaatattgcacaatggaggaaactctgatgcagcgatgccgcgtgagggaagaaggttttaggattgtaaacctctgtcttcagggacgaaaaaagacggtacctgaggaggaagctccggctaactacgtgccagcagccgcggtaatacgtagggagcgagcgttgtccggaattactgggtgtaaagggagcgtaggcgggatcgcaagtcagatgtgaaaactatgggcttaacccataaactgcatttgaaactgtggttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgccgtaaacgatgattactaggtgtggggggactgaccccttccgtgccgcagcaaacgcaataagtaatccacctggggagtacgaccgcaaggttgaaactcaaaggaattgacgggggcccgcacaagcagtggagtatgtggattaattcgaagcaacgcgaagaaccttaccaggtcttgacatcgtatgcatagctcagagatgagtgaaatctcttcggagacatatagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggcctcacacgtactacaatggctgtaaacagagggatgcaaagccgcgaggtggagcgaacccctaaaagcagtcttagttcggattgtaggctgcaacccgcctacatgaagtcggaattgctagtaatcgcagatcagcatgctgcggtgaatacgttcccgggccttgtacacaccgcccgtcacgccatgggagtcggtaacacccgaagcctgtagtctaaccgcaaggaggacgcagtcgaaggtgggattgatgactggggtgaagtcgtaacaaggtagccgtatcggaaggtgcggctggatcacctcctttcta

SEQ ID NO: 8045 - DNA, 1254 bp, Ruminococcus sp. AF21-3
  ref <308>: DATABASE ACCESSION NUMBER: NCBI ACCESSION: NZ_QUGC01000176.1
  ref <309>: DATABASE ENTRY DATE: 2019-04-01
  ref <313>: RELEVANT RESIDUES IN SEQ ID NO: (1)..(1254)
ttttatcagagagtttgatcctggctcaggatgaacgctggcggcgtgcttaacacatgcaagtcgaacgggaattattttattgaaacttcggtcgatttaatttaattctagtggcggacgggtgagtaacgcgtgggtaacctgccttatacagggggataacagtcagaaatgactgctaataccgcataagcgcacaggaccgcatggtccggtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcaaagctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgactcttaaccgagtctttccttcgggacagaggagacaggtggtgcatggttgtcgtcagctcgtgtcgtgagatgttgggttaagtcccgcaacgagcgcaacccctatcctcagtagccagcaagttaagttgggcactctgtggagactgccagggataacctggaggaaggcggggatgacgtcaaatcatcatgccccttatgatttgggctacacacgtgctacaatggcgtaaacaaagggaagcgaga

SEQ ID NO: 8046 - DNA, 1142 bp, Ruminococcus sp. AF21-42
  ref <308>: DATABASE ACCESSION NUMBER: NCBI ACCESSION: NZ_QUGB01000004.1
  ref <309>: DATABASE ENTRY DATE: 2019-04-01
  ref <313>: RELEVANT RESIDUES IN SEQ ID NO: (1)..(1142)
tttaatcagagagtttgatcctggctcaggatgaacgctggcggcgtgcttaacacatgcaagtcgaacgggaattatcttattgaaacttcggtcgatttaatttaattctagtggcggacgggggagtaacgcgtgggtaacctgccttatacagggggctaaaaggcagaaatgactgctaataccgcataagcgcacagagctgcttggctcagtgtgaaaaactccggtggtataagatggacacgcgttggattagcttgttggcagggtaacggcctaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcaaagctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaaatcttgacatccctctgaccggtctttaatcggacctttccttcgggacaggggagacaggtggtgcatggttgtcgtcagctcgtgtcgtgagatgttgggttaagtcccgcaacgagcgcaacccctatcctcagtagccagcatttaaggtgggcactctgg

SEQ ID NO: 8047 - DNA, 1541 bp, Ruminococcus sp. AF25-13
  ref <308>: DATABASE ACCESSION NUMBER: NCBI ACCESSION: NZ_QTWH01000048.1
  ref <309>: DATABASE ENTRY DATE: 2019-04-01
  ref <313>: RELEVANT RESIDUES IN SEQ ID NO: (1)..(1541)
tttaacgagagtttgatcctggctcaggatgaacgctggcggcgtgcttaacacatgcaagtcgaacgaagcaccttattctgatttcttcggaatgaaaaatttggtgactgagtggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagtggcaagtctgatgtgaaaacccggggctcaaccccgggactgcattggaaactgtcaatctagagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttccttcgggacagggatgacaggtggtgcatggttgtcgtcagctcgtgtcgtgagatgttgggttaagtcccgcaacgagcgcaacccctatctttagtagccagcggttcggccgggcactctagagagactgccagggataacctggaggaaggtggggatgacgtcaaatcatcatgccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 8048 - DNA, 1250 bp, Ruminococcus sp. AF25-17
  ref <308>: DATABASE ACCESSION NUMBER: NCBI ACCESSION: NZ_QTWG01000138.1
  ref <309>: DATABASE ENTRY DATE: 2019-04-01
  ref <313>: RELEVANT RESIDUES IN SEQ ID NO: (1)..(1250)
caggggtaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagtggcaagtctgatgtgaaaacccggggctcaaccccgggactgcattggaaactgtcaatctagagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttccttcgggacagggatgacaggtggtgcatggttgtcgtcagctcgtgtcgtgagatgttgggttaagtcccgcaacgagcgcaacccctatctttagtagccagcggttcggccgggcactctagagagactgccagggataacctggaggaaggtggggatgacgtcaaatcatcatgccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtggg

SEQ ID NO: 8049 - DNA, 1405 bp, Ruminococcus sp. AF25-19
  ref <308>: DATABASE ACCESSION NUMBER: NCBI ACCESSION: NZ_QTWF01000009.1
  ref <309>: DATABASE ENTRY DATE: 2019-04-01
  ref <313>: RELEVANT RESIDUES IN SEQ ID NO: (1)..(1405)
gagtaacacgtgagcaatctgcctttcagagggggataccgattggaaacgatcgttaataccgcataacataattgaaccgcatgatttgattatcaaagatttatcgctgaaagatgagctcgcgtctgattagctagttggtaaggtaacggcttaccaaggcgacgatcagtagccggactgagaggttgatcggccacattgggactgagacacggcccagactcctacgggaggcagcagtggggaatattgcacaatggaggaaactctgatgcagcgatgccgcgtgagggaagaaggttttaggattgtaaacctctgtcttcagggacgaaaaaagacggtacctgaggaggaagctccggctaactacgtgccagcagccgcggtaatacgtagggagcgagcgttgtccggaattactgggtgtaaagggagcgtaggcgggatcgcaagtcagatgtgaaaactatgggcttaacccataaactgcatttgaaactgtggttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgccgtaaacgatgattactaggtgtggggggactgaccccttccgtgccgcagcaaacgcaataagtaatccacctggggagtacgaccgcaaggttgaaactcaaaggaattgacgggggcccgcacaagcagtggagtatgtggattaattcgaagcaacgcgaagaaccttaccaggtcttgacatcgtatgcatagctcagagatgagtgaaatctcttcggagacatatagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggcctcacacgtactacaatggctgtaaacagagggatgcaaagccgcgaggtggagcgaacccctaaaagcagtcttagttcggattgtaggctgcaacccgcctacatgaagtcggaattgctagtaatcgcagatcagcatgctgcggtgaatacgttcccgggccttgtacacaccgcccgtcacgccatgggagtcggtaacacccgaagcctgtagtctaaccgcaaggaggacgcagtcgaaggtgggattgatgactggggtgaagtcgtaacaaggtagccgtatcggaaggtgcggctggatcacctcctttcta

SEQ ID NO: 8050 - DNA, 964 bp, Ruminococcus sp. AF25-23LB
  ref <308>: DATABASE ACCESSION NUMBER: NCBI ACCESSION: NZ_QUFL01000249.1
  ref <309>: DATABASE ENTRY DATE: 2019-04-01
  ref <313>: RELEVANT RESIDUES IN SEQ ID NO: (1)..(964)
gcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagat

SEQ ID NO: 8051 - DNA, 968 bp, Ruminococcus sp. AF25-28AC
  ref <308>: DATABASE ACCESSION NUMBER: NCBI ACCESSION: NZ_QUFJ01000005.1
  ref <309>: DATABASE ENTRY DATE: 2019-04-01
  ref <313>: RELEVANT RESIDUES IN SEQ ID NO: (1)..(968)
tggctcaggatgaacgctggcggcgtgcttaacacatgcaagtcgaacgggaattactttattgaaacttcggtcgatttaatttaattctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatcc

SEQ ID NO: 8052 - DNA, 1250 bp, Ruminococcus sp. AF25-3LB; identical to SEQ ID NO: 8048
  ref <308>: DATABASE ACCESSION NUMBER: NCBI ACCESSION: NZ_QTWE01000131.1
  ref <309>: DATABASE ENTRY DATE: 2019-04-01
  ref <313>: RELEVANT RESIDUES IN SEQ ID NO: (1)..(1250)

SEQ ID NO: 8053 - DNA, 1516 bp, Ruminococcus sp. AF26-25AA
  ref <308>: DATABASE ACCESSION NUMBER: NCBI ACCESSION: NZ_QTWC01000024.1
  ref <309>: DATABASE ENTRY DATE: 2019-04-01
  ref <313>: RELEVANT RESIDUES IN SEQ ID NO: (1)..(1516)
tttaattaagagtttgatcctggctcaggacgaacgctggcggcacgcttaacacatgcaagtcgaacgagagaagaggagcttgcttttctgatctagtggcggacgggtgagtaacacgtgagcaatctgcctttcagagggggataccgattggaaacgatcgttaataccgcataacataattgaaccgcatgatttgattatcaaagatttatcgctgaaagatgagctcgcgtctgattagctagttggtaaggtaacggcttaccaaggcgacgatcagtagccggactgagaggttgatcggccacattgggactgagacacggcccagactcctacgggaggcagcagtggggaatattgcacaatggaggaaactctgatgcagcgatgccgcgtgagggaagaaggttttaggattgtaaacctctgtcttcggggacgaaaaaagacggtacctgaggaggaagctccggctaactacgtgccagcagccgcggtaatacgtagggagcgagcgttgtccggaattactgggtgtaaagggagcgtaggcgggatcgcaagtcagatgtgaaaactatgggcttaacccataaactgcatttgaaactgtggttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgccgtaaacgatgattactaggtgtggggggactgaccccttccgtgccgcagcaaacgcaataagtaatccacctggggagtacgaccgcaaggttgaaactcaaaggaattgacgggggcccgcacaagcagtggagtatgtggattaattcgaagcaacgcgaagaaccttaccaggtcttgacatcgtatgcatagctcagagatgagtgaaatctcttcggagacatatagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggcctcacacgtactacaatggctgtaaacagagggatgcaaagccgcgaggtagagcgaacccctaaaagcagtcttagttcggattgtaggctgcaacccgcctacatgaagtcggaattgctagtaatcgcagatcagcatgctgcggtgaatacgttcccgggccttgtacacaccgcccgtcacgccatgggagtcggtaacacccgaagcctgtagtctaaccgcaaggaggacgcagtcgaaggtgggattgatgactggggtgaagtcgtaacaaggtagccgtatcggaaggtgcggctggatcacctcctttcta

SEQ ID NO: 8054 - DNA, 1539 bp, Ruminococcus sp. AF27-11AA
  ref <308>: DATABASE ACCESSION NUMBER: NCBI ACCESSION: NZ_QTWB01000006.1
  ref <309>: DATABASE ENTRY DATE: 2019-04-01
  ref <313>: RELEVANT RESIDUES IN SEQ ID NO: (1)..(1539)
tttaacgagagtttgatcctggctcaggatgaacgctggcggcgtgcttaacacatgcaagtcgaacgaagcaccttgatttgattcttcggatgaagatcttggtgactgagtggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagtggcaagtctgatgtgaaaacccggggctcaaccccgggactgcattggaaactgtcaatctagagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttccttcgggacagggatgacaggtggtgcatggttgtcgtcagctcgtgtcgtgagatgttgggttaagtcccgcaacgagcgcaacccctatctttagtagccagcggtcaggccgggcactctagagagactgccagggataacctggaggaaggtggggatgacgtcaaatcatcatgccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 8055 - DNA, 1539 bp, Ruminococcus sp. AF27-12AA; identical to SEQ ID NO: 8054
  ref <308>: DATABASE ACCESSION NUMBER: NCBI ACCESSION: NZ_QTWA01000075.1
  ref <309>: DATABASE ENTRY DATE: 2019-04-01
  ref <313>: RELEVANT RESIDUES IN SEQ ID NO: (1)..(1539)

SEQ ID NO: 8056 - DNA, 1539 bp, Ruminococcus sp. AF27-3
  ref <308>: DATABASE ACCESSION NUMBER: NCBI ACCESSION: NZ_QTVY01000005.1
  ref <309>: DATABASE ENTRY DATE: 2019-04-01
  ref <313>: RELEVANT RESIDUES IN SEQ ID NO: (1)..(1539)
tttaacgagagtttgatcctggctcaggatgaacgctggcggcgtgcttaacacatgcaagtcgaacgaagcaccttgatttgattcttcggatgaagatcttggtgactgagtggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagtggcaagtctgatgtgaaaacccggggctcaaccccgggactgcattggaaactgtcaatctagagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttccttcgggacagggatgacaggtggtgcatggttgtcgtcagctcgtgtcgtgagatgttgggttaagtcccgcaacgagcgcaacccctatctttagtagccagcggttcggccgggcactctagagagactgccagggataacctggaggaaggtggggatgacgtcaaatcatcatgccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 8057 - DNA, 1541 bp, Ruminococcus sp. AF31-14BH
  ref <308>: DATABASE ACCESSION NUMBER: NCBI ACCESSION: NZ_QTVO01000017.1
  ref <309>: DATABASE ENTRY DATE: 2019-04-01
  ref <313>: RELEVANT RESIDUES IN SEQ ID NO: (1)..(1541)
tttaacgagagtttgatcctggctcaggatgaacgctggcggcgtgcttaacacatgcaagtcgaacgaagcacttttatctgatttcttcggaatgaagattttggtgactgagtggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagtggcaagtctgatgtgaaaacccggggctcaaccccgggactgcattggaaactgtcaatctagagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttccttcgggacagggatgacaggtggtgcatggttgtcgtcagctcgtgtcgtgagatgttgggttaagtcccgcaacgagcgcaacccctatctttagtagccagcggttcggccgggcactctagagagactgccagggataacctggaggaaggtggggatgacgtcaaatcatcatgccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 8058 - DNA, 1438 bp, Ruminococcus sp. AF31-16BH
  ref <308>: DATABASE ACCESSION NUMBER: NCBI ACCESSION: NZ_QUEK01000003.1
  ref <309>: DATABASE ENTRY DATE: 2019-04-01
  ref <313>: RELEVANT RESIDUES IN SEQ ID NO: (1)..(1438)
ttttatcagagagtttgatcctggctcaggatgaacgctggcggcgtgcttaacacatgcaagtcgaacgggaaatacttcattgagacttcggtggatttgatttatttctagtggcggacgggtgagtaacgcgtgggtaacctgccttatacagggggataacagtcagaaatgactgctaataccgcataagcgcacaggaccgcatggtccggtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcatggccattcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgactcttaaccgagtctttccttcgggacagaggagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaac

SEQ ID NO: 8059 - DNA, 1433 bp, Ruminococcus sp. AF31-8BH
  ref <308>: DATABASE ACCESSION NUMBER: NCBI ACCESSION: NZ_QTVN01000010.1
  ref <309>: DATABASE ENTRY DATE: 2019-04-01
  ref <313>: RELEVANT RESIDUES IN SEQ ID NO: (1)..(1433)
tttatcagagagtttgatcctggctcaggatgaacgctggcggcgtgcttaacacatgcaagtcgaacgggaaatactttattgaaacttcggtcgatttaatctatttctagtggcggacgggtgagtaacgcgtgggtaacctgccttataccgggggataacagccagaaatggctgctaataccgcataagcgcacggaggcgcatgtctctgtgtgaaaaactccggtggtataagatggacccgcgttggattagctagttggcagggcagcggcctaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagataatgacggtacctgactaagaagccccggctaactacgtgccagcagccgcggtaatacgtagggggcgagcgttatccggatttactgggtgtaaagggagcgtagacggcgtatcaagtctgatgtgaaaggcaggggcttaacccctggactgcattggaaactggtatgcttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtctgggagcacagctcttaggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaaatcttgacatccctctgacagagtatgtaatgtacttttccttcgggacaggggagacaggtggtgcatggttgtcgtcagctcgtgtcgtgagatgttgggttaagtcccgcaacgagcgcaacccctatccttagtagccagcaagtaatgttgggcactctgaggagactgccagggataacctggaggaaggcggggatgacgtcaaatcatcatgccccttatgatttgggctacacacgtgctacaatggcgtaaacaaagggaagcgaacctgtgagggtgggcaaatctcaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgac

SEQ ID NO: 8060 - DNA, 1541 bp, Ruminococcus sp. AF32-2AC
  ref <308>: DATABASE ACCESSION NUMBER: NCBI ACCESSION: NZ_QTVM01000002.1
  ref <309>: DATABASE ENTRY DATE: 2019-04-01
  ref <313>: RELEVANT RESIDUES IN SEQ ID NO: (1)..(1541)
tttaacgagagtttgatcctggctcaggatgaacgctggcggcgtgcttaacacatgcaagtcgaacgaagcaccttattctgatttcttcggaatgaagattttggtgactgagtggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagtggcaagtctgatgtgaaaacccggggctcaaccccgggactgcattggaaactgtcaatctagagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttccttcgggacagggatgacaggtggtgcatggttgtcgtcagctcgtgtcgtgagatgttgggttaagtcccgcaacgagcgcaacccctatctttagtagccagcggttcggccgggcactctagagagactgccagggataacctggaggaaggtggggatgacgtcaaatcatcatgccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 8061 - DNA, 1412 bp, Ruminococcus sp. AF33-11BH
  ref <308>: DATABASE ACCESSION NUMBER: NCBI ACCESSION: NZ_QUEF01000054.1
  ref <309>: DATABASE ENTRY DATE: 2019-04-01
  ref <313>: RELEVANT RESIDUES IN SEQ ID NO: (1)..(1412)
gagtaacgcgtgggtaacctgccttatacagggggataacagtcagaaatggctgctaataccgcataagcgcacagagctgcatggctcagtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctcctttctaagg

SEQ ID NO: 8062 - DNA, 1516 bp, Ruminococcus sp. AF34-12
  ref <308>: DATABASE ACCESSION NUMBER: NCBI ACCESSION: NZ_QTVK01000003.1
  ref <309>: DATABASE ENTRY DATE: 2019-04-01
  ref <313>: RELEVANT RESIDUES IN SEQ ID NO: (1)..(1516)
tttaattaagagtttgatcctggctcaggacgaacgctggcggcacgcttaacacatgcaagtcgaacgagagaagagaagcttgcttttctgatctagtggcggacgggtgagtaacacgtgagcaatctgcctttcagagggggataccgattggaaacgatcgttaataccgcataatataattgaaccgcatgatttgattatcaaagatttatcgctgaaagatgagctcgcgtctgattagctagttggtaaggtaacggcttaccaaggcgacgatcagtagccggactgagaggttgatcggccacattgggactgagacacggcccagactcctacgggaggcagcagtggggaatattgcacaatggaggaaactctgatgcagcgatgccgcgtgagggaagaaggttttaggattgtaaacctctgtcttcagggacgaaaaaagacggtacctgaggaggaagctccggctaactacgtgccagcagccgcggtaatacgtagggagcgagcgttgtccggaattactgggtgtaaagggagcgtaggcgggatcgcaagtcagatgtgaaaactatgggcttaacccataaactgcatttgaaactgtggttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgccgtaaacgatgattactaggtgtggggggactgaccccttccgtgccgcagcaaacgcaataagtaatccacctggggagtacgaccgcaaggttgaaactcaaaggaattgacgggggcccgcacaagcagtggagtatgtggattaattcgaagcaacgcgaagaaccttaccaggtcttgacatcgtatgcatagctcagagatgagtgaaatctcttcggagacatatagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggcctcacacgtactacaatggctgttaacagagggatgcaaagccgcgaggtagagcgaacccctaaaagcagtcttagttcggattgtaggctgcaacccgcctacatgaagtcggaattgctagtaatcgcagatcagcatgctgcggtgaatacgttcccgggccttgtacacaccgcccgtcacgccatgggagtcggtaacacccgaagcctgtagtctaaccgcaaggaggacgcagtcgaaggtgggattgatgactggggtgaagtcgtaacaaggtagccgtatcggaaggtgcggctggatcacctcctttcta

SEQ ID NO: 8063 - DNA, 1539 bp, Ruminococcus sp. AF37-3AC
  ref <308>: DATABASE ACCESSION NUMBER: NCBI ACCESSION: NZ_QTVD01000021.1
  ref <309>: DATABASE ENTRY DATE: 2019-04-01
  ref <313>: RELEVANT RESIDUES IN SEQ ID NO: (1)..(1539)
aaattttagagagtttgatcctggctcaggacgaacgctggcggcgtgcctaacacatgcaagtcgaacggaactgttttgaaagatttcttcggaatgaatttgatttagtttagtggcggacgggtgagtaacgcgtgagtaacctgccttcaagagggggataacattctgaaaagaatgctaataccgcatgacatatcggaatcacatggttttgatatcaaagattttatcgcttgaagatggactcgcgtccgattagttagttggtgaggtaacggctcaccaagaccgcgatcggtagccggactgagaggttgaacggccacattgggactgagacacggcccagactcctacgggaggcagcagtgggggatattgcgcaatgggggcaaccctgacgcagcaacgccgcgtgaaggatgaaggttttcggattgtaaacttcttttattaaggacgaaaattgacggtacttaatgaataagctccggctaactacgtgccagcagccgcggtaatacgtagggagcaagcgttgtccggatttactgggtgtaaagggtgcgtaggcggctttgcaagtcagatgtgaaatctatgggctcaacccataaactgcatttgaaactgtagagcttgagtgaagtagaggcaggcggaattccccgtgtagcggtgaaatgcgtagagatggggaggaacaccagtggcgaaggcggcctgctgggctttaactgacgctgaggcacgaaagcgtgggtagcaaacaggattagataccctggtagtccacgctgtaaacgatgattactaggtgtggggggtctgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccaactaacgaagtagagatacattaggtgcccttcggggaaagttgagacaggtggtgcatggttgtcgtcagctcgtgtcgtgagatgttgggttaagtcccgcaacgagcgcaacccttgctattagttgctacgcaagagcactctaataggactgccgttgacaaaacggaggaaggtggggacgacgtcaaatcatcatgccccttatgacctgggctacacacgtactacaatggatgttaacagagggaagcaagacagcgatgtggagcaaacccctaaaaacattctcagttcagattgcaggctgcaacccgcctgcatgaagatggaattgctagtaatcgcggatcagcatgccgcggtgaatacgttcccgggccttgtacacaccgcccgtcacaccatgggagccggtaatacccgaagtcagtagtccaacctcgtgaggacgctgccgaaggtaggattggcgactggggtgaagtcgtaacaaggtagccgtatcggaaggtgcggctggatcacctcctttctatgga

SEQ ID NO: 8064 - DNA, 1150 bp, Ruminococcus sp. AF41-9
  ref <308>: DATABASE ACCESSION NUMBER: NCBI ACCESSION: NZ_QUDO01000123.1
  ref <309>: DATABASE ENTRY DATE: 2019-04-01
  ref <313>: RELEVANT RESIDUES IN SEQ ID NO: (1)..(1150)
gggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcatggccattcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccctctgaccggaacttaaccgttcctttccttcgggacaggggagacaggtggtgcatggttgtcgtcagctcgtgtcgtgagatgttgggttaagtcccgcaacgagcgcaacccctatcctcagtagccagcatgtaagatgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaaccgcgagggaggagctgccgaaggcgggaccgatgactggggtgaagtcgtaacaaggtagccgtatcggaaggtgcggctggatcacctcctttctaaggaa

SEQ ID NO: 8065 - DNA, 1539 bp, Ruminococcus sp. AF42-10
  ref <308>: DATABASE ACCESSION NUMBER: NCBI ACCESSION: NZ_QTVC01000032.1
  ref <309>: DATABASE ENTRY DATE: 2019-04-01
  ref <313>: RELEVANT RESIDUES IN SEQ ID NO: (1)..(1539)
aaattttagagagtttgatcctggctcaggacgaacgctggcggcgtgcctaacacatgcaagtcgaacggaactgttttgaaagatttcttcggaatgaatttgatttagtttagtggcggacgggtgagtaacgcgtgagtaacctgccttcaagagggggataacattctgaaaaggatgctaataccgcatgacatatcggaaccacatggttctgatatcaaagattttatcgcttgaagatggactcgcgtccgattagttagttggtgaggtaacggctcaccaagaccgcgatcggtagccggactgagaggttgaacggccacattgggactgagacacggcccagactcctacgggaggcagcagtgggggatattgcgcaatgggggcaaccctgacgcagcaacgccgcgtgaaggatgaaggttttcggattgtaaacttcttttattaaggacgaaatttgacggtacttaatgaataagctccggctaactacgtgccagcagccgcggtaatacgtagggagcaagcgttgtccggatttactgggtgtaaagggtgcgtaggcggctttgcaagtcagatgtgaaatctatgggctcaacccataaactgcatttgaaactgtagagcttgagtgaagtagaggcaggcggaattccccgtgtagcggtgaaatgcgtagagatggggaggaacaccagtggcgaaggcggcctgctgggctttaactgacgctgaggcacgaaagcgtgggtagcaaacaggattagataccctggtagtccacgctgtaaacgatgattactaggtgtggggggtctgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccaactaacgaagtagagatacattaggtgcccttcggggaaagttgagacaggtggtgcatggttgtcgtcagctcgtgtcgtgagatgttgggttaagtcccgcaacgagcgcaacccttgctattagttgctacgcaagagcactctaataggactgccgttgacaaaacggaggaaggtggggacgacgtcaaatcatcatgccccttatgacctgggctacacacgtactacaatggatgttaacagagggaagcaagacagcgatgtggagcaaacccctaaaaacattctcagttcagattgcaggctgcaacccgcctgcatgaagatggaattgctagtaatcgcggatcagcatgccgcggtgaatacgttcccgggccttgtacacaccgcccgtcacaccatgggagccggtaatacccgaagtcagtagtccaacctcgtgaggacgctgccgaaggtaggattggcgactggggtgaagtcgtaacaaggtagccgtatcggaaggtgcggctggatcacctcctttctatgga

SEQ ID NO: 8066 - DNA, 1254 bp, Ruminococcus sp. AF42-9BH
  ref <308>: DATABASE ACCESSION NUMBER: NCBI ACCESSION: NZ_QUDM01000053.1
  ref <309>: DATABASE ENTRY DATE: 2019-04-01
  ref <313>: RELEVANT RESIDUES IN SEQ ID NO: (1)..(1254)
ttttatcagagagtttgatcctggctcaggatgaacgctggcggcgtgcttaacacatgcaagtcgaacgggaaatacttcattgagacttcggtggatttgatttatttctagtggcggacgggtgagtaacgcgtgggtaacctgccttatacagggggataacagtcagaaatgactgctaataccgcataagcgcacaggaccgcatggtccggtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgactcttaaccgagtctttccttcgggacagaggagacaggtggtgcatggttgtcgtcagctcgtgtcgtgagatgttgggttaagtcccgcaacgagcgcaacccctatcctcagtagccagcaagttgagttgggcactctgtggagactgccagggataacctggaggaaggcggggatgacgtcaaatcatcatgccccttatgatttgggctacacacgtgctacaatggcgtaaacaaagggaagcgaga

SEQ ID NO: 8067 - DNA, 1539 bp, Ruminococcus sp. AF43-11
  ref <308>: DATABASE ACCESSION NUMBER: NCBI ACCESSION: NZ_QTVA01000042.1
  ref <309>: DATABASE ENTRY DATE: 2019-04-01
  ref <313>: RELEVANT RESIDUES IN SEQ ID NO: (1)..(1539)
aaattttagagagtttgatcctggctcaggacgaacgctggcggcgtgcctaacacatgcaagtcgaacggaactgttttgaaagatttcttcggaatgaatttgatttagtttagtggcggacgggtgagtaacgcgtgagtaacctgccttcaagagggggataacattctgaaaagaatgctaataccgcatgatatatcggaaccacatggttttgatatcaaagattttatcgcttgaagatggactcgcgtccgattagttagttggtgaggtaacggctcaccaagaccgcgatcggtagccggactgagaggttgaacggccacattgggactgagacacggcccagactcctacgggaggcagcagtgggggatattgcgcaatgggggcaaccctgacgcagcaacgccgcgtgaaggatgaaggttttcggattgtaaacttcttttattaaggacgaaaaatgacggtacttaatgaataagctccggctaactacgtgccagcagccgcggtaatacgtagggagcaagcgttgtccggatttactgggtgtaaagggtgcgtaggcggctttgcaagtcagatgtgaaatctatgggctcaacccataaactgcatttgaaactgtagagcttgagtgaagtagaggcaggcggaattccccgtgtagcggtgaaatgcgtagagatggggaggaacaccagtggcgaaggcggcctgctgggctttaactgacgctgaggcacgaaagcgtgggtagcaaacaggattagataccctggtagtccacgctgtaaacgatgattactaggtgtggggggtctgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccaactaacgaagtagagatacattaggtgcccttcggggaaagttgagacaggtggtgcatggttgtcgtcagctcgtgtcgtgagatgttgggttaagtcccgcaacgagcgcaacccttgctattagttgctacgcaagagcactctaataggactgccgttgacaaaacggaggaaggtggggacgacgtcaaatcatcatgccccttatgacctgggctacacacgtactacaatggatgttaacagagggaagcaagacagcgatgtggagcaaacccctaaaaacattctcagttcagattgcaggctgcaacccgcctgcatgaagatggaattgctagtaatcgcggatcagcatgccgcggtgaatacgttcccgggccttgtacacaccgcccgtcacaccatgggagccggtaatacccgaagtcagtagtccaacctcgtgaggacgctgccgaaggtaggattggcgactggggtgaagtcgtaacaaggtagccgtatcggaaggtgcggctggatcacctcctttctatgga

SEQ ID NO: 8068 - DNA, 1466 bp, Ruminococcus sp. AF45-4BH
  ref <308>: DATABASE ACCESSION NUMBER: NCBI ACCESSION: NZ_QUDK01000070.1
  ref <309>: DATABASE ENTRY DATE: 2019-04-01
  ref <313>: RELEVANT RESIDUES IN SEQ ID NO: (1)..(1466)
accttttattgaagcttcggcagatttagctggtttctagtggcggacgggtgagtaacgcgtgggtaacctgccctatacagggggataacaaccagaaatggttgctaataccgcataagcgcacaggaccgcatggtccggtgtgaaaaactccggtggtataggatggacccgcgttggattagccagttggcagggtaacggcctaccaaagcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggattagcaagtctgatgtgaaaggcaggggctcaacccctggactgcattggaaactgccagtcttgagtgccggagaggtaagcggaattcctagtgtagcggtgaaatgcgtagatattaggaggaacaccagtggcgaaggcggcttactggacggcaactgacgttgaggctcgaaagcgtggggagcaaacaggattagataccctggtagtccacgccgtaaacgatgaatactaggtgttggggagcaaagctcttcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgactcttaaccgagtctttccttcgggacaggggagacaggtggtgcatggttgtcgtcagctcgtgtcgtgagatgttgggttaagtcccgcaacgagcgcaacccctatccccagtagccagcagttcggctgggcactctgaggagactgccagggataacctggaggaaggcggggatgacgtcaaatcatcatgccccttatgatttgggctacacacgtgctacaatggcgtaaacaaagggaagcaagcctgcgagggtaagcaaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaaccgcaagggaggagctgccgaaggcgggaccgatgactggggtgaagtcgtaacaaggtagccgtatcggaaggtgcggctggatcacctcctttctaaggaa

SEQ ID NO: 8069 - DNA, 1540 bp, Ruminococcus sp. AM07-21
  ref <308>: DATABASE ACCESSION NUMBER: NCBI ACCESSION: NZ_QRMT01000004.1
  ref <309>: DATABASE ENTRY DATE: 2019-04-01
  ref <313>: RELEVANT RESIDUES IN SEQ ID NO: (1)..(1540)
ttttatcagagagtttgatcctggctcaggatgaacgctggcggcgtgcttaacacatgcaagtcgaacgggaaatacttcattgagacttcggtggatttgatttatttctagtggcggacgggtgagtaacgcgtgggtaacctgccttatacagggggataacagtcagaaatgactgctaataccgcataagcgcacaggaccgcatggtccggtgtgaaaaactccggtggtataagatggacccgcgttggattagctggttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccctctgacctactcttaaccgagtctttccttcgggacagaggagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaaccgcaagggaggagctgccgaaggcgggaccgatgactggggggaagtcgtaacaaggtagccgtatcggaaggtgcggctggattacctcctttctaaggaa

SEQ ID NO: 8070 - DNA, 1541 bp, Ruminococcus sp. AM09-18-1
  ref <308>: DATABASE ACCESSION NUMBER: NCBI ACCESSION: NZ_QTUX01000009.1
  ref <309>: DATABASE ENTRY DATE: 2019-04-01
  ref <313>: RELEVANT RESIDUES IN SEQ ID NO: (1)..(1541)
tttaacgagagtttgatcctggctcaggatgaacgctggcggcgtgcttaacacatgcaagtcgaacgaagcacttttatttgatttcttcggaatgaagattttggtgactgagtggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagtggcaagtctgatgtgaaaacccggggctcaaccccgggactgcattggaaactgtcaatctagagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttccttcgggacagggatgacaggtggtgcatggttgtcgtcagctcgtgtcgtgagatgttgggttaagtcccgcaacgagcgcaacccctatctttagtagccagcggttcggccgggcactctagagagactgccagggataacctggaggaaggtggggatgacgtcaaatcatcatgccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 8071 - DNA, 1275 bp, Ruminococcus sp. AM12-48
  ref <308>: DATABASE ACCESSION NUMBER: NCBI ACCESSION: NZ_QUDA01000073.1
  ref <309>: DATABASE ENTRY DATE: 2019-04-01
  ref <313>: RELEVANT RESIDUES IN SEQ ID NO: (1)..(1275)
gttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagccccgcaacgagcgcaccccctatcctcagtagccagcatttaaggtgggcactctggggagactgcgagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctcctttctaaggaa

SEQ ID NO: 8072 - DNA, 1539 bp, Ruminococcus sp. AM16-34
  ref <308>: DATABASE ACCESSION NUMBER: NCBI ACCESSION: NZ_QTUR01000007.1
  ref <309>: DATABASE ENTRY DATE: 2019-04-01
  ref <313>: RELEVANT RESIDUES IN SEQ ID NO: (1)..(1539)
tttaacgagagtttgatcctggctcaggatgaacgctggcggcgtgcttaacacatgcaagtcgaacgaagcaccttgatttgattcttcggatgaagatcttggtgactgagtggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagtggcaagtctgatgtgaaaacccggggctcaaccccgggactgcattggaaactgtcaatctagagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttccttcgggacagggatgacaggtggtgcatggttgtcgtcagctcgtgtcgtgagatgttgggttaagtcccgcaacgagcgcaacccctatctttagtagccagcggtttggccgggcactctagagagactgccagggataacctggaggaaggtggggatgacgtcaaatcatcatgccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 8073 - DNA, 1539 bp, Ruminococcus sp. AM18-15
  ref <308>: DATABASE ACCESSION NUMBER: NCBI ACCESSION: NZ_QUCS01000015.1
  ref <309>: DATABASE ENTRY DATE: 2019-04-01
  ref <313>: RELEVANT RESIDUES IN SEQ ID NO: (1)..(1539)
ttaatcagagagtttgatcctggctcaggatgaacgctggcggcgtgcttaacacatgcaagtcgaacgggaaatatttcattgagacttcggtggatttgatctatttctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcaaagctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctcctttctaaggaa

SEQ ID NO: 8074 - DNA, 508 bp, Ruminococcus sp. AM18-44
  ref <308>: DATABASE ACCESSION NUMBER: NCBI ACCESSION: NZ_QUCP01000108.1
  ref <309>: DATABASE ENTRY DATE: 2019-04-01
  ref <313>: RELEVANT RESIDUES IN SEQ ID NO: (1)..(508)
gacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctcctttctaaggaa

SEQ ID NO: 8075 - DNA, 1539 bp, Ruminococcus sp. AM22-13
  ref <308>: DATABASE ACCESSION NUMBER: NCBI ACCESSION: NZ_QRIL01000017.1
  ref <309>: DATABASE ENTRY DATE: 2019-04-01
  ref <313>: RELEVANT RESIDUES IN SEQ ID NO: (1)..(1539)
tttatcagagagtttgatcctggctcaggatgaacgctggcggcgtgcttaacacatgcaagtcgaacgggaatcacttcattgagacttcggtggatttgatttgattctagtggcggacgggtgagtaacgcgtgggtaacctgccttatacagggggataacagtcagaaatgactgctaataccgcataagcgcacaggaccgcatggtccggtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgactcttaaccgagtctttccttcgggacagaggagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctcctttctaaggaa

SEQ ID NO: 8076 - DNA, 1541 bp, Ruminococcus sp. AM22-14LB
  ref <308>: DATABASE ACCESSION NUMBER: NCBI ACCESSION: NZ_QTUP01000019.1
  ref <309>: DATABASE ENTRY DATE: 2019-04-01
  ref <313>: RELEVANT RESIDUES IN SEQ ID NO: (1)..(1541)
tttaacgagagtttgatcctggctcaggatgaacgctggcggcgtgcttaacacatgcaagtcgaacgaagcacttttatttgatttcttcggaatgaagattttagtgactgagtggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagtggcaagtctgatgtgaaaacccggggctcaaccccgggactgcattggaaactgtcaatctagagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttccttcgggacagggatgacaggtggtgcatggttgtcgtcagctcgtgtcgtgagatgttgggttaagtcccgcaacgagcgcaacccctatctttagtagccagcggttcggccgggcactctagagagactgccagggataacctggaggaaggtggggatgacgtcaaatcatcatgccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 8077 - DNA, 1539 bp, Ruminococcus sp. AM23-1
  ref <308>: DATABASE ACCESSION NUMBER: NCBI ACCESSION: NZ_QUCJ01000036.1
  ref <309>: DATABASE ENTRY DATE: 2019-04-01
  ref <313>: RELEVANT RESIDUES IN SEQ ID NO: (1)..(1539)
tttatcagagagtttgatcctggctcaggatgaacgctggcggcgtgcttaacacatgcaagtcgaacgggaaaccttttattgaagcttcggcagatttagattgtttctagtggcggacgggtgagtaacgcgtgggtaacctgccttatacagggggataacagtcagaaatgactgctaataccgcataagcgcacagagctgcatggctcggtgtgaaaaactccggtggtataagatggacccgcgttggattagctagttggtgaggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggatggacaagtctgatgtgaaaggctggggctcaaccccgggactgcattggaaactgcccgtcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgcggtaaacgatgaatgctaggtgtcggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaagtcttgacatccctctgaccgactcttaaccgagtctttccttcgggacagaggagacaggtggtgcatggttgtcgtcagctcgtgtcgtgagatgttgggttaagtcccgcaacgagcgcaacccctatcctcagtagccagcatataagatgggcactctggggagactgccagggataacctggaggaaggcggggatgacgtcaaatcatcatgccccttatgatttgggctacacacgtgctacaatggcgtaaacaaagggaagcgaacctgcgagggtgggcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaaccgcaaggaaggagctgccgaaggcgggaccgatgactggggtgaagtcgtaacaaggtagccgtatcggaaggtgcggctggatcacctcctttctaaggaa

SEQ ID NO: 8078 - DNA, 1252 bp, Ruminococcus sp. AM23-1LB
  ref <308>: DATABASE ACCESSION NUMBER: NCBI ACCESSION: NZ_QUCI01000034.1
  ref <309>: DATABASE ENTRY DATE: 2019-04-01
  ref <313>: RELEVANT RESIDUES IN SEQ ID NO: (1)..(1252)
tttatcagagagtttgatcctggctcaggatgaacgctggcggcgtgcttaacacatgcaagtcgaacgggaattactttattgaaacttcggtcgatttaatttaattctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagctagttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcaaagctcttcggtgccgtcccaaacgcagtaagtatccctcctgggcagtacggtcgcaagaatgaacctaaaggcaattgacggggaccctcacaagcggtggagcatgtggtttaattcgaagcaactcgaagacccttaccaagtcttgacatccgcctgcccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgaga

SEQ ID NO: 8079 - DNA, 1435 bp, Ruminococcus sp. AM27-11LB
  ref <308>: DATABASE ACCESSION NUMBER: NCBI ACCESSION: NZ_QTYQ01000027.1
  ref <309>: DATABASE ENTRY DATE: 2019-04-01
  ref <313>: RELEVANT RESIDUES IN SEQ ID NO: (1)..(1435)
gtgactgagtggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagtggcaagtctgatgtgaaaacccggggctcaaccccgggactgcattggaaactgtcaatctagagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttccttcgggacagggatgacaggtggtgcatggttgtcgtcagctcgtgtcgtgagatgttgggttaagtcccgcaacgagcgcaacccctatctttagtagccagcggttcggccgggcactctagagagactgccagggataacctggaggaaggtggggatgacgtcaaatcatcatgccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 8080 - DNA, 1511 bp, Ruminococcus sp. AM27-16
  ref <308>: DATABASE ACCESSION NUMBER: NCBI ACCESSION: NZ_QUJV01000016.1
  ref <309>: DATABASE ENTRY DATE: 2019-04-01
  ref <313>: RELEVANT RESIDUES IN SEQ ID NO: (1)..(1511)
tttatcagagagcttgatcctggctcaggatgaacgctggcggcgtgcttaacacatgcaaggcgaacgggaaatatttcattgagacttcggtggatttgatctatttctagtggcggacgggtgaggaacgcgtgggtaacctgccttatacagggggataatagtcagaaatggctgctaataccgcataagcgcacagagctgcatggctcagtatgaaaaacttcggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcaaagctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaaatcttgacatccctctgaccggtctttaatcggaccttctcttcggagcagaggtgacaggtggtgcatggttgtcgtcagctcgtgtcgtgagatgttgggttaagtcccgcaacgagtgcaacccctatcctcagtagccagcaagttaagttgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaagg

SEQ ID NO: 8081 - DNA, 1541 bp, Ruminococcus sp. AM27-27; identical to SEQ ID NO: 8076
  ref <308>: DATABASE ACCESSION NUMBER: NCBI ACCESSION: NZ_QTYP01000001.1
  ref <309>: DATABASE ENTRY DATE: 2019-04-01
  ref <313>: RELEVANT RESIDUES IN SEQ ID NO: (1)..(1541)

SEQ ID NO: 8082 - DNA, 1516 bp, Ruminococcus sp. AM28-13
  ref <308>: DATABASE ACCESSION NUMBER: NCBI ACCESSION: NZ_QTYO01000010.1
  ref <309>: DATABASE ENTRY DATE: 2019-04-01
  ref <313>: RELEVANT RESIDUES IN SEQ ID NO: (1)..(1516)
tttaattaagagtttgatcctggctcaggacgaacgctggcggcacgcttaacacatgcaagtcgaacgagagaagagaagcttgcttttctgatctagtggcggacgggtgagtaacacgtgagcaatctgcctttcagagggggataccgattggaaacgatcgttaataccgcataatataattgaaccgcatgatttgattatcaaagatttatcgctgaaagatgagctcgcgtctgattagctagttggtaaggtaacggcttaccaaggcgacgatcagtagccggactgagaggttgatcggccacattgggactgagacacggcccagactcctacgggaggcagcagtggggaatattgcacaatggaggaaactctgatgcagcgatgccgcgtgagggaagaaggttttaggattgtaaacctctgtcttcagggacgaaaaatgacggtacctgaggaggaagctccggctaactacgtgccagcagccgcggtaatacgtagggagcgagcgttgtccggaattactgggtgtaaagggagcgtaggcgggatcgcaagtcagatgtgaaaactatgggcttaacccataaactgcatttgaaactgtggttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgccgtaaacgatgattactaggtgtggggggactgaccccttccgtgccgcagcaaacgcaataagtaatccacctggggagtacgaccgcaaggttgaaactcaaaggaattgacgggggcccgcacaagcagtggagtatgtggattaattcgaagcaacgcgaagaaccttaccaggtcttgacatcgtatgcatagctcagagatgagtgaaatctcttcggagacatatagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggcctcacacgtactacaatggctgtcaacagagggatgcaaagccgcgaggtggagcgaacccctaaaagcagtcttagttcggattgtaggctgcaacccgcctacatgaagtcggaattgctagtaatcgcagatcagcatgctgcggtgaatacgttcccgggccttgtacacaccgcccgtcacgccatgggagtcggtaacacccgaagcctgtagtctaaccgcaaggaggacgcagtcgaaggtgggattgatgactggggtgaagtcgtaacaaggtagccgtatcggaaggtgcggctggatcacctcctttcta

SEQ ID NO: 8083 - DNA, 1539 bp, Ruminococcus sp. AM28-29LB
  ref <308>: DATABASE ACCESSION NUMBER: NCBI ACCESSION: NZ_QTYN01000023.1
  ref <309>: DATABASE ENTRY DATE: 2019-04-01
  ref <313>: RELEVANT RESIDUES IN SEQ ID NO: (1)..(1539)
aaattttagagagtttgatcctggctcaggacgaacgctggcggcgtgcctaacacatgcaagtcgaacggaactgttttgaaagatttcttcggaatgaatttgatttagtttagtggcggacgggtgagtaacgcgtgagtaacctgccttcaagagggggataacattctgaaaagaatgctaataccgcatgacatatcggaaccacatgattttgatatcaaagattttatcgcttgaagatggactcgcgtccgattagttagttggtgaggtaacggctcaccaagaccgcgatcggtagccggactgagaggttgaacggccacattgggactgagacacggcccagactcctacgggaggcagcagtgggggatattgcgcaatgggggcaaccctgacgcagcaacgccgcgtgaaggatgaaggttttcggattgtaaacttcttttattaaggacgaaaaatgacggtacttaatgaataagctccggctaactacgtgccagcagccgcggtaatacgtagggagcaagcgttgtccggatttactgggtgtaaagggtgcgtaggcggctttgcaagtcagatgtgaaatctatgggctcaacccataaactgcatttgaaactgtagagcttgagtgaagtagaggcaggcggaattccccgtgtagcggtgaaatgcgtagagatggggaggaacaccagtggcgaaggcggcctgctgggctttaactgacgctgaggcacgaaagcgtgggtagcaaacaggattagataccctggtagtccacgctgtaaacgatgattactaggtgtggggggtctgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccaactaacgaagtagagatacattaggtgcccttcggggaaagttgagacaggtggtgcatggttgtcgtcagctcgtgtcgtgagatgttgggttaagtcccgcaacgagcgcaacccttgctattagttgctacgcaagagcactctaataggactgccgttgacaaaacggaggaaggtggggacgacgtcaaatcatcatgccccttatgacctgggctacacacgtactacaatggatgttaacagagggaagcaagacagcgatgtggagcaaacccctaaaaacattctcagttcagattgtaggctgcaacccgcctgcatgaagatggaattgctagtaatcgcggatcagcatgccgcggtgaatacgttcccgggccttgtacacaccgcccgtcacaccatgggagccggtaatacccgaagtcagtagtccaacctcgtgaggacgctgccgaaggtaggattggcgactggggtgaagtcgtaacaaggtagccgtatcggaaggtgcggctggatcacctcctttctatgga

SEQ ID NO: 8084 - DNA, 1438 bp, Ruminococcus sp. AM28-41
  ref <308>: DATABASE ACCESSION NUMBER: NCBI ACCESSION: NZ_QUJJ01000015.1
  ref <309>: DATABASE ENTRY DATE: 2019-04-01
  ref <313>: RELEVANT RESIDUES IN SEQ ID NO: (1)..(1438)
ttttatcagagagtttgatcctggctcaggatgaacgctggcggcgtgcttaacacatgcaagtcgaacgggaatcacttcattgagacttcggtggatttgatttgattctagtggcggacgggtgagtaacgcgtgggtaacctgccttatacagggggataacagtcagaaatgactgctaataccgcataagcgcacaggaccgcatggtccggtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgactcttaaccgagtctttccttcgggacagaggagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaac

SEQ ID NO: 8085 - DNA, 1539 bp, Ruminococcus sp. AM29-1; identical to SEQ ID NO: 8042
  ref <308>: DATABASE ACCESSION NUMBER: NCBI ACCESSION: NZ_QTYL01000007.1
  ref <309>: DATABASE ENTRY DATE: 2019-04-01
  ref <313>: RELEVANT RESIDUES IN SEQ ID NO: (1)..(1539)

SEQ ID NO: 8086 - DNA, 1539 bp, Ruminococcus sp. AM29-10LB; identical to SEQ ID NO: 8042
  ref <308>: DATABASE ACCESSION NUMBER: NCBI ACCESSION: NZ_QTYK01000009.1
  ref <309>: DATABASE ENTRY DATE: 2019-04-01
  ref <313>: RELEVANT RESIDUES IN SEQ ID NO: (1)..(1539)

SEQ ID NO: 8087 - DNA, 1522 bp, Ruminococcus sp. AM29-12LB
  ref <308>: DATABASE ACCESSION NUMBER: NCBI ACCESSION: NZ_QUJH01000022.1
  ref <309>: DATABASE ENTRY DATE: 2019-04-01
  ref <313>: RELEVANT RESIDUES IN SEQ ID NO: (1)..(1522)
tttatcagagagtttgatcctggctcaggatgaacgctggcggcgtgcttaacgcatgcaagtcgaacgggaattactttattgaaacttcggtcgatttaatttaattctagtggcggacgggggagcaacgcgtggggaacctgccttatacagggggataacagtccgaaatggctgctaataccgcataagcgcacagagctgcatggctcagagtgaaaaactccggtggtataagatggacccgcgttggattagctagttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagatcccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcaggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatc

SEQ ID NO: 8088 - DNA, 1539 bp, Ruminococcus sp. AM29-19LB; identical to SEQ ID NO: 8042
  ref <308>: DATABASE ACCESSION NUMBER: NCBI ACCESSION: NZ_QTYJ01000009.1
  ref <309>: DATABASE ENTRY DATE: 2019-04-01
  ref <313>: RELEVANT RESIDUES IN SEQ ID NO: (1)..(1539)

SEQ ID NO: 8089 - DNA, 1439 bp, Ruminococcus sp. AM29-26
  ref <308>: DATABASE ACCESSION NUMBER: NCBI ACCESSION: NZ_QUJE01000009.1
  ref <309>: DATABASE ENTRY DATE: 2019-04-01
  ref <313>: RELEVANT RESIDUES IN SEQ ID NO: (1)..(1439)
ttttatcagagagtttgatcctggctcaggatgaacgctggcggcgtgcttaacacatgcaagtcgaacgggaatcacttcattgagacttcggtggatttgatttgattctagtggcggacgggtgagtaacgcgtgggtaacctgccttatacagggggataacagtcagaaatgactgctaataccgcataagcgcacaggaccgcatggtccggtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgactcttaaccgagtctttccttcgggacagaggagacaggtggtgcatggttgtcgtcagctcgtgtcgtgagatgttgggttaagtcccgcaacgagcgcaacccctatcctcagtagccagcaagttaagttgggcactctgtggagactgccagggataacctggaggaaggcggggatgacgtcaaatcatcatgccccttatgatttgggctacacacgtgctacaatggcgtaaacaaagggaagcgagagggtgacctggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaac

SEQ ID NO: 8090 - DNA, 1438 bp, Ruminococcus sp. AM29-5AC
  ref <308>: DATABASE ACCESSION NUMBER: NCBI ACCESSION: NZ_QTYH01000039.1
  ref <309>: DATABASE ENTRY DATE: 2019-04-01
  ref <313>: RELEVANT RESIDUES IN SEQ ID NO: (1)..(1438)
ttggtgactgagtggcggacgggtgagtaacgcgtgggtaacctgcctcatacagggggataacagttagaaatgactgctaataccgcataagaccacagcaccgcatggtacaggggtaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagtggcaagtctgatgtgaaaacccggggctcaaccccgggactgcattggaaactgtcaatctagagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttcctttgggacagggatgacaggtggtgcatggttgtcgtcagctcgtgtcgtgagatgttgggttaagtcccgcaacgagcgcaacccctatctttagtagccagcggttcggccgggcactctagagagactgccagggataacctggaggaaggtggggatgacgtcaaatcatcatgccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 8091 - DNA, 1540 bp, Ruminococcus sp. AM30-15AC
  ref <308>: DATABASE ACCESSION NUMBER: NCBI ACCESSION: NZ_QSJR01000012.1
  ref <309>: DATABASE ENTRY DATE: 2019-04-01
  ref <313>: RELEVANT RESIDUES IN SEQ ID NO: (1)..(1540)
tttatcagagagtttgatcctggctcaggatgaacgctggcggcgtgcttaacacatgcaagtcgaacgggaaatacttcattgagacttcggtggatttgatttatttctagtggcggacgggtgagtaacgcgtgggtaacctgccttatacagggggataacagtcagaaatgactgctaataccgcataagcgcacaggaccgcatggtccggtgtgaaaaactccggtggtataagatggacccgcgttggattagctggttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgactcttaaccgagtctttccttcgggacagaggagacaggtggtgcatggttgtcgtcagctcgtgtcgtgagatgttgggttaagtcccgcaacgagcgcaacccctatcctcagtagccagcaagttaagttgggcactctgtggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctcctttctaaggaa

SEQ ID NO: 8092 - DNA, 1515 bp, Ruminococcus sp. AM31-15AC
  ref <308>: DATABASE ACCESSION NUMBER: NCBI ACCESSION: NZ_QTYG01000084.1
  ref <309>: DATABASE ENTRY DATE: 2019-04-01
  ref <313>: RELEVANT RESIDUES IN SEQ ID NO: (1)..(1515)
tttaattaagagtttgatcctggctcaggacgaacgctggcggcacgcttaacacatgcaagtcgaacgagagaagagaagcttgcttttctgatctagtggcggacgggtgagtaacacgtgagcaatctgcctttcagagggggataccgattggaaacgatcgttaataccgcataatataattgaaccgcatgatttgattatcaaagatttatcgctgaaagatgagctcgcgtctgattagctagttggtaaggtaacggcctaccaagcgacgatcagtagccggactgagaggttgatcggccacattgggactgagacacggcccagactcctacgggaggcagcagtggggaatattgcacaatggaggaaactctgatgcagcgatgccgcgtgagggaagaaggttttaggattgtaaacctctgtcttcagggacgaaaaaagacggtacctgaggaggaagctccggctaactacgtgccagcagccgcggtaatacgtagggagcgagcgttgtccggaattactgggtgtaaagggagcgtaggcgggatcgcaagtcagatgtgaaaactatgggcttaacccataaactgcatttgaaactgtggttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgccgtaaacgatgattactaggtgtggggggactgaccccttccgtgccgcagcaaacgcaataagtaatccacctggggagtacgaccgcaaggttgaaactcaaaggaattgacgggggcccgcacaagcagtggagtatgtggattaattcgaagcaacgcgaagaaccttaccaggtcttgacatcgtatgcatagctcagagatgagtgaaatctcttcggagacatatagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggcctcacacgtactacaatggctgtcaacagagggaagcaaagccgcgaggtggagcgaacccctaaaagcagtcttagttcggattgtaggctgcaacccgcctacatgaagtcggaattgctagtaatcgcagatcagcatgctgcggtgaatacgttcccgggccttgtacacaccgcccgtcacgccatgggagtcggtaacacccgaagcctgtagtctaaccgtaaggaggacgcagtcgaaggtgggattgatgactggggtgaagtcgtaacaaggtagccgtatcggaaggtgcggctggatcacctcctttcta

SEQ ID NO: 8093 - DNA, 1539 bp, Ruminococcus sp. AM31-32
  ref <308>: DATABASE ACCESSION NUMBER: NCBI ACCESSION: NZ_QTYF01000004.1
  ref <309>: DATABASE ENTRY DATE: 2019-04-01
  ref <313>: RELEVANT RESIDUES IN SEQ ID NO: (1)..(1539)
aaattttagagagtttgatcctggctcaggacgaacgctggcggcgtgcctaacacatgcaagtcgaacggaactgttttgaaagatttcttcggaatgaatttgatttagtttagtggcggacgggtgagtaacgcgtgagtaacctgccttcaagagggggataacattctgaaaagaatgctaataccgcatgacatatcggaaccacatggctctgatatcaaagattttatcgcttgaagatggactcgcgtccgattagttagttggtgaggtaacggctcaccaagaccgcgatcggtagccggactgagaggttgaacggccacattgggactgagacacggcccagactcctacgggaggcagcagtgggggatattgcgcaatgggggcaaccctgacgcagcaacgccgcgtgaaggatgaaggttttcggattgtaaacttcttttattaaggacgaaaaatgacggtacttaatgaataagctccggctaactacgtgccagcagccgcggtaatacgtagggagcaagcgttgtccggatttactgggtgtaaagggtgcgtaggcggctttgcaagtcagatgtgaaatctatgggctcaacccataaactgcatttgaaactgtagagcttgagtgaagtagaggcaggcggaattccccgtgtagcggtgaaatgcgtagagatggggaggaacaccagtggcgaaggcggcctgctgggctttaactgacgctgaggcacgaaagcgtgggtagcaaacaggattagataccctggtagtccacgctgtaaacgatgattactaggtgtggggggtctgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccaactaacgaagtagagatacattaggtgcccttcggggaaagttgagacaggtggtgcatggttgtcgtcagctcgtgtcgtgagatgttgggttaagtcccgcaacgagcgcaacccttgctattagttgctacgcaagagcactctaataggactgccgttgacaaaacggaggaaggtggggacgacgtcaaatcatcatgccccttatgacctgggctacacacgtactacaatggatgttaacagagggaagcaagacagcgatgtggagcaaacccctaaaaacattctcagttcagattgcaggctgcaacccgcctgcatgaagatggaattgctagtaatcgcggatcagcatgccgcggtgaatacgttcccgggccttgtacacaccgcccgtcacaccatgggagccggtaatacccgaagtcagtagtccaacctcgtgaggacgctgccgaaggtaggattggcgactggggtgaagtcgtaacaaggtagccgtatcggaaggtgcggctggatcacctcctttctatgga

SEQ ID NO: 8094 - DNA, 1435 bp, Ruminococcus sp. AM33-14
  ref <308>: DATABASE ACCESSION NUMBER: NCBI ACCESSION: NZ_QTYE01000055.1
  ref <309>: DATABASE ENTRY DATE: 2019-04-01
  ref <313>: RELEVANT RESIDUES IN SEQ ID NO: (1)..(1435)
gtgactgagtggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagtggcaagtctgatgtgaaaacccggggctcaaccccgggactgcattggaaactgtcaatctagagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttccttcgggacagggatgacaggtggtgcatggttgtcgtcagctcgtgtcgtgagatgttgggttaagtcccgcaacgagcgcaacccctatctttagtagccagcggtttggccgggcactctagagagactgccagggataacctggaggaaggtggggatgacgtcaaatcatcatgccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 8095 - DNA, 1539 bp, Ruminococcus sp. AM34-10LB
  ref <308>: DATABASE ACCESSION NUMBER: NCBI ACCESSION: NZ_QTYD01000003.1
  ref <309>: DATABASE ENTRY DATE: 2019-04-01
  ref <313>: RELEVANT RESIDUES IN SEQ ID NO: (1)..(1539)
aaattttagagagtttgatcctggctcaggacgaacgctggcggcgtgcctaacacatgcaagtcgaacggaactgttttgaaagatttcttcggaatgaatttgatttagtttagtggcggacgggtgagtaacgcgtgagtaacctgccttcaagagggggataacattctgaaaagaatgctaataccgcatgatatatcggaaccacatggttttgatatcaaaggttttatcgcttgaagatggactcgcgtccgattagttagttggtgaggtaacggctcaccaagaccgcgatcggtagccggactgagaggttgaacggccacattgggactgagacacggcccagactcctacgggaggcagcagtgggggatattgcgcaatgggggcaaccctgacgcagcaacgccgcgtgaaggatgaaggttttcggattgtaaacttcttttattaaggacgaaacttgacggtacttaatgaataagctccggctaactacgtgccagcagccgcggtaatacgtagggagcaagcgttgtccggatttactgggtgtaaagggtgcgtaggcggctttgcaagtcagatgtgaaatctatgggctcaacccataaactgcatttgaaactgtagagcttgagtgaagtagaggcaggcggaattccccgtgtagcggtgaaatgcgtagagatggggaggaacaccagtggcgaaggcggcctgctgggctttaactgacgctgaggcacgaaagcgtgggtagcaaacaggattagataccctggtagtccacgctgtaaacgatgattactaggtgtggggggtctgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccaactaacgaagtagagatacattaggtgcccttcggggaaagttgagacaggtggtgcatggttgtcgtcagctcgtgtcgtgagatgttgggttaagtcccgcaacgagcgcaacccttgctattagttgctacgcaagagcactctaataggactgccgttgacaaaacggaggaaggtggggacgacgtcaaatcatcatgccccttatgacctgggctacacacgtactacaatggatgttaacagagggaagcaagacagcgatgtggagcaaacccctaaaaacattctcagttcagattgcaggctgcaacccgcctgcatgaagatggaattgctagtaatcgcggatcagcatgccgcggtgaatacgttcccgggccttgtacacaccgcccgtcacaccatgggagccggtaatacccgaagtcagtagtccaacctcgtgaggacgctgccgaaggtaggattggcgactggggtgaagtcgtaacaaggtagccgtatcggaaggtgcggctggatcacctcctttctatgga

SEQ ID NO: 8096 - DNA, 1409 bp, Ruminococcus sp. AM36-17
  ref <308>: DATABASE ACCESSION NUMBER: NCBI ACCESSION: NZ_QUIS01000073.1
  ref <309>: DATABASE ENTRY DATE: 2019-04-01
  ref <313>: RELEVANT RESIDUES IN SEQ ID NO: (1)..(1409)
gagtaacgcgtgggtaacctgccttatacagggggataacagtcagaaatggctgctaataccgcataagcgcacagagctgcatggctcagtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcggggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaaatcttgacatccctctgaccggtctttaatcggaccttctcttcggagcagaggtgacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctcctttcta

SEQ ID NO: 8097 - DNA, 1539 bp, Ruminococcus sp. AM36-18
  ref <308>: DATABASE ACCESSION NUMBER: NCBI ACCESSION: NZ_QTYC01000006.1
  ref <309>: DATABASE ENTRY DATE: 2019-04-01
  ref <313>: RELEVANT RESIDUES IN SEQ ID NO: (1)..(1539)
aaattttagagagtttgatcctggctcaggacgaacgctggcggcgtgcctaacacatgcaagtcgaacggaactgttttgaaagatttcttcggaatgaatttgatttagtttagtggcggacgggtgagtaacgcgtgagtaacctgccttcaagagggggataacattctgaaaaggatgctaataccgcatgacatatcggaaccacatggttctgatatcaaagattttatcgcttgaagatggactcgcgtccgattagttagttggtgaggtaacggctcaccaagaccgcgatcggtagccggactgagaggttgaacggccacattgggactgagacacggcccagactcctacgggaggcagcagtgggggatattgcgcaatgggggcaaccctgacgcagcaacgccgcgtgaaggatgaaggttttcggattgtaaacttcttttattaaggacgaaaaatgacggtacttaatgaataagctccggctaactacgtgccagcagccgcggtaatacgtagggagcaagcgttgtccggatttactgggtgtaaagggtgcgtaggcggctttgcaagtcagatgtgaaatctatgggctcaacccataaactgcatttgaaactgtagagcttgagtgaagtagaggcaggcggaattccccgtgtagcggtgaaatgcgtagagatggggaggaacaccagtggcgaaggcggcctgctgggctttaactgacgctgaggcacgaaagcgtgggtagcaaacaggattagataccctggtagtccacgctgtaaacgatgattactaggtgtggggggtctgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccaactaacgaagtagagatacattaggtgcccttcggggaaagttgagacaggtggtgcatggttgtcgtcagctcgtgtcgtgagatgttgggttaagtcccgcaacgagcgcaacccttgctattagttgctacgcaagagcactctaataggactgccgttgacaaaacggaggaaggtggggacgacgtcaaatcatcatgccccttatgacctgggctacacacgtactacaatggatgttaacagagggaagcaagacagcgatgtggagcaaacccctaaaaacattctcagttcagattgcaggctgcaacccgcctgcatgaagatggaattgctagtaatcgcggatcagcatgccgcggtgaatacgttcccgggccttgtacacaccgcccgtcacaccatgggagccggtaatacccgaagtcagtagtccaacctcgtgaggacgctgccgaaggtaggattggcgactggggtgaagtcgtaacaaggtagccgtatcggaaggtgcggctggatcacctcctttctatgga

SEQ ID NO: 8098 - DNA, 1540 bp, Ruminococcus sp. AM36-2AA
  ref <308>: DATABASE ACCESSION NUMBER: NCBI ACCESSION: NZ_QTYB01000033.1
  ref <309>: DATABASE ENTRY DATE: 2019-04-01
  ref <313>: RELEVANT RESIDUES IN SEQ ID NO: (1)..(1540)
ttttatcagagagtttgatcctggctcaggatgaacgctggcggcgtgcttaacacatgcaagtcgaacgggaaaccttttattgaagcttcggcagatttatctggtttctagtggcggacgggtgagtaacgcgtgggtaacctgccttgtacagggggataacagtcagaaatgactgctaataccgcataagcgcacaggaccgcatggtccggtgtgaaaaactccggtggtataagatggacccgcgttggattagctagttggcagggtaacggcctaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggatggacaagtctgatgtgaaaggctggggctcaaccccgggactgcattggaaactgcccgtcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgcggtaaacgatgaatgctaggtgtcgggtgacaaagtcattcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaagtcttgacatccttctgaccggaacttaaccgttcctttccttcggggcagaggagacaggtggtgcatggttgtcgtcagctcgtgtcgtgagatgttgggttaagtcccgcaacgagcgcaacccctatccccagtagccagcatttaaggtgggcactctgaggagactgccagggataacctggaggaaggcggggatgacgtcaaatcatcatgccccttatgatttgggctacacacgtgctacaatggcgtaaacaaagggaagcgaacccgcgagggtgggcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaaccgtaaggagggagctgccgaaggcgggaccgatgactggggtgaagtcgtaacaaggtagccgtatcggaaggtgcggctggatcacctcctttctaaggaa

SEQ ID NO: 8099 - DNA, 1252 bp, Ruminococcus sp. AM40-10AC
  ref <308>: DATABASE ACCESSION NUMBER: NCBI ACCESSION: NZ_QUIR01000004.1
  ref <309>: DATABASE ENTRY DATE: 2019-04-01
  ref <313>: RELEVANT RESIDUES IN SEQ ID NO: (1)..(1252)
tttatcagagagtttgatcctggctcaggatgaacgctggcggcgtgcttaacacatgcaagtcgaacgggaattactttattgaaacttcggtcgatttaatttatttctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcagagccattcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgaga

SEQ ID NO: 8100 - DNA, 1335 bp, Ruminococcus sp. AM41-10BH
  ref <308>: DATABASE ACCESSION NUMBER: NCBI ACCESSION: NZ_QTXY01000038.1
  ref <309>: DATABASE ENTRY DATE: 2019-04-01
  ref <313>: RELEVANT RESIDUES IN SEQ ID NO: (1)..(1335)
ccgcatggtccggtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggatggacaagtctgatgtgaaaggctggggctcaaccccgggactgcattggaaactgcccgtcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgcggtaaacgatgaatgctaggtgtcgggtgacaaagtcattcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaagtcttgacatccctctgaccgactcttaaccgagtcttcccttcggggcagaggagacaggtggtgcatggttgtcgtcagctcgtgtcgtgagatgttgggttaagtcccgcaacgagcgcaacccctatccccagtagccagcatttaaggtgggcactctgaggagactgccagggataacctggaggaaggcggggatgacgtcaaatcatcatgccccttatgatttgggctacacacgtgctacaatggcgtaaacaaagggaagcgaacccgcgagggtgggcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaaccgtaaggagggagctgccgaaggcgggaccgatgactggggtgaagtcgtaacaaggtagccgtatcggaaggtgcggctggatcacctcctttctaaggaa

SEQ ID NO: 8101 - DNA, 1539 bp, Ruminococcus sp. AM41-2AC; identical to SEQ ID NO: 8072
  ref <308>: DATABASE ACCESSION NUMBER: NCBI ACCESSION: NZ_QTXX01000005.1
  ref <309>: DATABASE ENTRY DATE: 2019-04-01
  ref <313>: RELEVANT RESIDUES IN SEQ ID NO: (1)..(1539)

SEQ ID NO: 8102 - DNA, 1519 bp, Ruminococcus sp. AM42-10AC
  ref <308>: DATABASE ACCESSION NUMBER: NCBI ACCESSION: NZ_QUIP01000025.1
  ref <309>: DATABASE ENTRY DATE: 2019-04-01
  ref <313>: RELEVANT RESIDUES IN SEQ ID NO: (1)..(1519)
tggctcaggatgaacgctggcggcgtgcttaacacatgcaagtcgaacgggaaatatttcattgagacttcggtggatttgatctatttctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagctggttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctcctttctaaggaa

SEQ ID NO: 8103 - DNA, 1037 bp, Ruminococcus sp. AM42-11
  ref <308>: DATABASE ACCESSION NUMBER: NCBI ACCESSION: NZ_QUIO01000097.1
  ref <309>: DATABASE ENTRY DATE: 2019-04-01
  ref <313>: RELEVANT RESIDUES IN SEQ ID NO: (1)..(1037)
gtgtgaaaaactccggtggtataagatggacccgcgttggattagctagttggcagggcagcggcctaccaagcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagataatgacggtacctgactaagaagccccggctaactacgtgccagcagccgcggtaatacgtagggggcaagcgttatccggatttactgggtgtaaagggagcgtagacggcgcagcaagtctgatgtgaaaggcaggggcttaacccctggactgcattggaaactgctgtgcttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcagggagcacagctctttggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaaatcttgacatccctctgaccgggacttaaccgtccctttccttcgggacaggggagacaggtggtgcatggttgtcgtcagctcgtgtcgtgagatgttgggttaagtcccgcaacgagcgcaacccctatccttagtagccagcacgtaatggtgggcactctgaggagactgccagggataacctggaggaaggcggggatgacgtcaaatcatcatgccccttatgatttgggctacacacgtgctacaatggcgtaaacaaagggaagcgaacc

SEQ ID NO: 8104 - DNA, 1516 bp, Ruminococcus sp. AM43-6
  ref <308>: DATABASE ACCESSION NUMBER: NCBI ACCESSION: NZ_QTXU01000073.1
  ref <309>: DATABASE ENTRY DATE: 2019-04-01
  ref <313>: RELEVANT RESIDUES IN SEQ ID NO: (1)..(1516)
tttaattaagagtttgatcctggctcaggacgaacgctggcggcacgcttaacacatgcaagtcgaacgagagaagaggagcttgcttttctgatctagtggcggacgggtgagtaacacgtgagcaatctgcctttcagagggggataccgattggaaacgatcgttaataccgcataatataattgaaccgcatgatttgattatcaaagatttatcgctgaaagatgagctcgcgtctgattagctagttggtaaggtaacggcttaccaaggcgacgatcagtagccggactgagaggttgatcggccacattgggactgagacacggcccagactcctacgggaggcagcagtggggaatattgcacaatggaggaaactctgatgcagcgatgccgcgtgagggaagaaggttttaggattgtaaacctctgtcttcagggacgaaaaaagacggtacctgaggaggaagctccggctaactacgtgccagcagccgcggtaatacgtagggagcgagcgttgtccggaattactgggtgtaaagggagcgtaggcgggatcgcaagtcagatgtgaaaactatgggcttaacccataaactgcatttgaaactgtggttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgccgtaaacgatgattactaggtgtggggggactgaccccttccgtgccgcagcaaacgcaataagtaatccacctggggagtacgaccgcaaggttgaaactcaaaggaattgacgggggcccgcacaagcagtggagtatgtggattaattcgaagcaacgcgaagaaccttaccaggtcttgacatcgtatgcatagctcagagatgagtgaaatctcttcggagacatatagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggcctcacacgtactacaatggctgtaaacagagggatgcaaagccgcgaggtggagcgaacccctaaaagcagtcttagttcggattgtaggctgcaacccgcctacatgaagtcggaattgctagtaatcgcagatcagcatgctgcggtgaatacgttcccgggccttgtacacaccgcccgtcacgccatgggagtcggtaacacccgaagcctgtagtctaaccgtaaggaggacgcagtcgaaggtgggattgatgactggggtgaagtcgtaacaaggtagccgtatcggaaggtgcggctggatcacctcctttcta

SEQ ID NO: 8105 - DNA, 964 bp, Ruminococcus sp. AM44-9AT; identical to SEQ ID NO: 8050
  ref <308>: DATABASE ACCESSION NUMBER: NCBI ACCESSION: NZ_QUIG01000144.1
  ref <309>: DATABASE ENTRY DATE: 2019-04-01
  ref <313>: RELEVANT RESIDUES IN SEQ ID NO: (1)..(964)

SEQ ID NO: 8106 - DNA, 1001 bp, Ruminococcus sp. AM45-2
  ref <308>: DATABASE ACCESSION NUMBER: NCBI ACCESSION: NZ_QUIF01000112.1
  ref <309>: DATABASE ENTRY DATE: 2019-04-01
  ref <313>: RELEVANT RESIDUES IN SEQ ID NO: (1)..(1001)
gcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcaaagctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagt

SEQ ID NO: 8107 - DNA, 1241 bp, Ruminococcus sp. AM45-9BH
  ref <308>: DATABASE ACCESSION NUMBER: NCBI ACCESSION: NZ_QUID01000115.1
  ref <309>: DATABASE ENTRY DATE: 2019-04-01
  ref <313>: RELEVANT RESIDUES IN SEQ ID NO: (1)..(1241)
gcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcaaagctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctcctt

SEQ ID NO: 8108 - DNA, 1001 bp, Ruminococcus sp. AM46-18; identical to SEQ ID NO: 8106
  ref <308>: DATABASE ACCESSION NUMBER: NCBI ACCESSION: NZ_QUIC01000174.1
  ref <309>: DATABASE ENTRY DATE: 2019-04-01
  ref <313>: RELEVANT RESIDUES IN SEQ ID NO: (1)..(1001)

SEQ ID NO: 8109 - DNA, 1515 bp, Ruminococcus sp. AM47-2BH
  ref <308>: DATABASE ACCESSION NUMBER: NCBI ACCESSION: NZ_QTXT01000049.1
  ref <309>: DATABASE ENTRY DATE: 2019-04-01
  ref <313>: RELEVANT RESIDUES IN SEQ ID NO: (1)..(1515)
tttaattaagagtttgatcctggctcaggacgaacgctggcggcacgcttaacacatgcaagtcgaacgagagaagagaagcttgcttttctgatctagtggcggacgggtgagtaacacgtgagcaatctgcctttcagagggggataccgattggaaacgatcgttaataccgcataatataattgaaccgcatgatttgattatcaaagatttatcgctgaaagatgagctcgcgtctgattagctagttggtaaggtaacggcttaccaagcgacgatcagtagccggactgagaggttgatcggccacattgggactgagacacggcccagactcctacgggaggcagcagtggggaatattgcacaatggaggaaactctgatgcagcgatgccgcgtgagggaagaaggttttaggattgtaaacctctgtcttcagggacgaaaaaagacggtacctgaggaggaagctccggctaactacgtgccagcagccgcggtaatacgtagggagcgagcgttgtccggaattactgggtgtaaagggagcgtaggcgggatcgcaagtcagatgtgaaaactatgggcttaacccataaactgcatttgaaactgtggttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgccgtaaacgatgattactaggtgtggggggactgaccccttccgtgccgcagcaaacgcaataagtaatccacctggggagtacgaccgcaaggttgaaactcaaaggaattgacgggggcccgcacaagcagtggagtatgtggattaattcgaagcaacgcgaagaaccttaccaggtcttgacatcgtatgcatagctcagagatgagtgaaatctcttcggagacatatagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggcctcacacgtactacaatggctgtcaacagagggatgcaaagccgcgaggtggagcgaacccctaaaagcagtcttagttcggattgtaggctgcaacccgcctacatgaagtcggaattgctagtaatcgcagatcagcatgctgcggtgaatacgttcccgggccttgtacacaccgcccgtcacgccatgggagtcggtaacacccgaagcctgtagtctaaccgcaaggaggacgcagtcgaaggtgggattgatgactggggtgaagtcgtaacaaggtagccgtatcggaaggtgcggctggatcacctcctttcta

SEQ ID NO: 8110 - DNA, 1541 bp, Ruminococcus sp. AM49-10BH; identical to SEQ ID NO: 8047
  ref <308>: DATABASE ACCESSION NUMBER: NCBI ACCESSION: NZ_QTVX01000004.1
  ref <309>: DATABASE ENTRY DATE: 2019-04-01
  ref <313>: RELEVANT RESIDUES IN SEQ ID NO: (1)..(1541)

SEQ ID NO: 8111 - DNA, 1541 bp, Ruminococcus sp. AM49-8; identical to SEQ ID NO: 8047
  ref <308>: DATABASE ACCESSION NUMBER: NCBI ACCESSION: NZ_QTVW01000010.1
  ref <309>: DATABASE ENTRY DATE: 2019-04-01
  ref <313>: RELEVANT RESIDUES IN SEQ ID NO: (1)..(1541)

SEQ ID NO: 8112 - DNA, 1436 bp, Ruminococcus sp. AM50-15BH
  ref <308>: DATABASE ACCESSION NUMBER: NCBI ACCESSION: NZ_QUFA01000101.1
  ref <309>: DATABASE ENTRY DATE: 2019-04-01
  ref <313>: RELEVANT RESIDUES IN SEQ ID NO: (1)..(1436)
ttaatcagagagtttgatcctggctcaggatgaacgctggcggcgtgcttaacacatgcaagtcgaacgggaaatatttcattgagacttcggtggatttgatctatttctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagctggttggtggggtaacggcccaccaagcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaac

SEQ ID NO: 8113 - DNA, 1148 bp, Ruminococcus sp. AM54-14NS
  ref <308>: DATABASE ACCESSION NUMBER: NCBI ACCESSION: NZ_QUEX01000114.1
  ref <309>: DATABASE ENTRY DATE: 2019-04-01
  ref <313>: RELEVANT RESIDUES IN SEQ ID NO: (1)..(1148)
gcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaac

SEQ ID NO: 8114 - DNA, 1515 bp, Ruminococcus sp. AM54-1NS
  ref <308>: DATABASE ACCESSION NUMBER: NCBI ACCESSION: NZ_QTVV01000065.1
  ref <309>: DATABASE ENTRY DATE: 2019-04-01
  ref <313>: RELEVANT RESIDUES IN SEQ ID NO: (1)..(1515)
tttaattaagagtttgatcctggctcaggacgaacgctggcggcacgcttaacacatgcaagtcgaacgagagaagaggagcttgcttttctgatctagtggcggacgggtgagtaacacgtgagcaatctgcctttcagagggggataccgattggaaacgatcgttaataccgcataatataattgaaccgcatgatttgattatcaaagatttatcgctgaaagatgagctcgcgtctgattagctagttggtaaggtaacggcttaccaagcgacgatcagtagccggactgagaggttgatcggccacattgggactgagacacggcccagactcctacgggaggcagcagtggggaatattgcacaatggaggaaactctgatgcagcgatgccgcgtgagggaagaaggttttaggattgtaaacctctgtcttcagggacgaaaaaagacggtacctgaggaggaagctccggctaactacgtgccagcagccgcggtaatacgtagggagcgagcgttgtccggaattactgggtgtaaagggagcgtaggcgggatcgcaagtcagatgtgaaaactatgggcttaacccataaactgcatttgaaactgtggttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgccgtaaacgatgattactaggtgtggggggactgaccccttccgtgccgcagcaaacgcaataagtaatccacctggggagtacgaccgcaaggttgaaactcaaaggaattgacgggggcccgcacaagcagtggagtatgtggattaattcgaagcaacgcgaagaaccttaccaggtcttgacatcgtatgcatagctcagagatgagtgaaatctcttcggagacatatagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggcctcacacgtactacaatggctgtaaacagagggatgcaaagccgcgaggtggagcgaacccctaaaagcagtcttagttcggattgtaggctgcaacccgcctacatgaagtcggaattgctagtaatcgcagatcagcatgctgcggtgaatacgttcccgggccttgtacacaccgcccgtcacgccatgggagtcggtaacacccgaagcctgtagtctaaccgcaaggaggacgcagtcgaaggtgggattgatgactggggtgaagtcgtaacaaggtagccgtatcggaaggtgcggctggatcacctcctttcta

SEQ ID NO: 8115 - DNA, 1541 bp, Ruminococcus sp. AM57-5
  ref <308>: DATABASE ACCESSION NUMBER: NCBI ACCESSION: NZ_QTVT01000083.1
  ref <309>: DATABASE ENTRY DATE: 2019-04-01
  ref <313>: RELEVANT RESIDUES IN SEQ ID NO: (1)..(1541)
tttaacgagagtttgatcctggctcaggatgaacgctggcggcgtgcttaacacatgcaagtcgaacgaagcacttttatttgatttcttcggaatgaagattttagtgactgagtggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagtggcaagtctgatgtgaaaacccggggctcaaccccgggactgcattggaaactgtcaatctagagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttccttcgggacagggaagacaggtggtgcatggttgtcgtcagctcgtgtcgtgagatgttgggttaagtcccgcaacgagcgcaacccctatctttagtagccagcggttcggccgggcactctagagagactgccagggataacctggaggaaggtggggatgacgtcaaatcatcatgccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 8116 - DNA, 733 bp, Ruminococcus sp. AM58-7XD
  ref <308>: DATABASE ACCESSION NUMBER: NCBI ACCESSION: NZ_QSDN01000308.1
  ref <309>: DATABASE ENTRY DATE: 2019-04-01
  ref <313>: RELEVANT RESIDUES IN SEQ ID NO: (1)..(733)
gggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgactcttaaccgagtctttccttcgggacagaggagacaggtggtgcatggttgtcgtcagctcgtgtcgtgagatgttgggttaagtcccgcaacgagcgcaacccctatcctcagtagccagca

SEQ ID NO: 8117 - DNA, 1526 bp, Ruminococcus sp. FC2018
  ref <308>: DATABASE ACCESSION NUMBER: NCBI ACCESSION: NZ_JHXH01000008.1
  ref <309>: DATABASE ENTRY DATE: 2019-04-01
  ref <313>: RELEVANT RESIDUES IN SEQ ID NO: (1)..(1526)
ttttaattaagagtttgatcctggctcaggacgaacgctggcggcacgcttaacacatgcaagtcgaacggggttacaagataagcttgcttaatttgtaacctagtggcggacgggtgagtaacacgtgagcaatctgcccttaagagggggataccagttagaaatgactgttaataccgcataagatagtagtaccgcatggtacagctataaaagatttatcgcttaaggatgagctcgcgtctgattagctagttggtgaggtaacggcccaccaaggcaacgatcagtagccggactgagaggttggacggccacattgggactgagacacggcccagactcctacgggaggcagcagtggggaatattgcacaatggaggaaactctgatgcagcgatgccgcgtgagggaagaaggttttaggattgtaaacctctgttgacagggacgataatgacggtacctgttgaggaagctccggctaactacgtgccagcagccgcggtaatacgtagggagcgagcgttgtccggaattactgggtgtaaagggagcgtaggcgggatcgcaagtcaggtgtgaaatgcgggggctcaacccccgaactgcacttgaaactgtggttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgccgtaaacgatgattactaggtgtggggggactgaccccttccgtgccgcagctaacgcaataagtaatccacctggggagtacgaccgcaaggttgaaactcaaaggaattgacgggggcccgcacaagcagtggagtatgtggattaattcgaagcaacgcgaagaaccttaccaggtcttgacatcgtacgcatagcatagagatatgtgaaatcccttcggggacgtatagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggcctcacacgtactacaatggctgccaacagagggaagcaaagcagtgatgcagagcaaagccccaaaagcagtcttagttcggattgcaggctgaaacccgcctgcatgaagtcggaattgctagtaatcgcagatcagcatgctgcggtgaatacgttcccgggccttgtacacaccgcccgtcacgccatgggagtcggtaacacccgaagcctgtagcccaaccgcaaggaggacgcagtcgaaggtgggattgatgactggggtgaagtcgtaacaaggtagccgtatcggaaggtgcggctggatcacctcctttctatgga

SEQ ID NO: 8118 - DNA, 1518 bp, Ruminococcus sp. HUN007
  ref <308>: DATABASE ACCESSION NUMBER: NCBI ACCESSION: NZ_JOOA01000002.1
  ref <309>: DATABASE ENTRY DATE: 2019-04-01
  ref <313>: RELEVANT RESIDUES IN SEQ ID NO: (1)..(1518)
ttttataaagagtttgatcctggctcaggatgaacgctggcggcacgcctaacacatgcaagtcgaacggagtttaagagagcttgctcttttaaacttagtggcggacgggtgagtaacacgtgagcaacctgcctttcagagagggatagcttctggaaacggatggtaatacctcataacatattgatacggcatcgtattgatatcaaagatttatcgctgaaagatgggctcgcgtctgattagctggttggtgaggtaacggcccaccaaggcaacgatcagtagccggactgagaggttgaacggccacattgggactgagacacggcccagactcctacgggaggcagcagtggggaatattgcacaatgggcgcaagcctgatgcagcgatgccgcgtgagggaagaaggttttcggattgtaaacctctgtcatcggggacgaaaatgacggtacccgagaaggaagctccggctaactacgtgccagcagccgcggtaatacgtagggagcaagcgttatccggaattactgggtgtaaagggagtgtaggcgggactgcaagtcagatgtgaaatatgccggctcaactggcagactgcatttgaaactgtggttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgctgtaaacgatgattactaggtgtggggggactgaccccttccgtgccgcagttaacacaataagtaatccacctggggagtacggccgcaaggctgaaactcaaaggaattgacgggggcccgcacaagcagtggagtatgtggtttaattcgaagcaacgcgaagaaccttaccaggtcttgacatcgagtgaagtatcaagagattgatatgtcttcggacacaaagacaggtggtgcatggttgtcgtcagctcgtgtcgtgagatgttgggttaagtcccgcaacgagcgcaacccttaccattagttgctacgcaagagcactctaatgggactgccgttgacaaaacggaggaaggtggggatgacgtcaaatcatcatgccccttatgacctgggctacacacgtactacaatggcaatcgaacagagggaagcaatacagcgatgtaaagcaaaacccgaaaaaattgtctcagttcggattgcaggctgcaacccgcctgcatgaagtcggaattgctagtaatcgcagatcagcatgctgcggtgaatacgttcccgggccttgtacacaccgcccgtcacaccatgggagtcggtaacacccgaagccagtagtccaaccgcaaggaggacgctgtcgaaggtgggattgatgactggggtgaagtcgtaacaaggtagccgtatcggaaggtgcggctggatcacctcctttctaagga

SEQ ID NO: 8119 - DNA, 1521 bp, Ruminococcus sp. Marseille-P6503
  ref <308>: DATABASE ACCESSION NUMBER: NCBI ACCESSION: NZ_UWPB01000002.1
  ref <309>: DATABASE ENTRY DATE: 2019-04-01
  ref <313>: RELEVANT RESIDUES IN SEQ ID NO: (1)..(1521)
ttaaattaagagtttgatcctggctcaggacgaacgctggcggcacgcttaacacatgcaagtcgaacgggcggaggaagagcttgcttttccgaagctagtggcggacgggtgagtaacacgtgagcaatctgcctttcagagggggatacctgttggaaacgacagttaataccgcataacatagtcataccgcatggtaaggctatcaaagatttatcgctgaaagatgagctcgcgtctgattagctagttggtgaggtaagggctcaccaaggcgacgatcagtagccggactgagaggttggacggccacattgggactgagacacggcccagactcctacgggaggcagcagtggggaatattgcacaatgggcgaaagcctgatgcagcgatgccgcgtgagggaagaaggttttaggattgtaaacctctgtcttaggggacgataatgacggtaccctaggaggaagctccggctaactacgtgccagcagccgcggtaatacgtagggagcgagcgttgtccggaattactgggtgtaaagggagtgtaggcgggactgcaagtcagatgtgaaaactatgggattaacccatagactgcacttgaaactgcggttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgccgtaaacgatgattactaggtgtggggggactgaccccttccgtgccgcagttaacacaataagtaatccacctggggagtacggccgcaaggctgaaactcaaaggaattgacgggggcccgcacaagcagtggagtatgtggattaattcgacgcaacgcgaagaaccttaccaggtcttgacatcgtacgcatagctcagagatgagtgaaatcccttcggggacgtacagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggcctcacacgtactacaatggctatgaacaaagtgaagcaaagccgcgaggcggagcaaaacacaaaaaatagtcttagttcggattgcaggctgcaacccgcctgcatgaagtcggaattgctagtaatcgcggatcagcatgccgcggtgaatacgttcccgggccttgtacacaccgcccgtcaaaccatgggagtcggtaacacccgaagccagtagtctaaccgcaagggggacgctgtcgaaggtgggattgatgactggggttaagtcgtaacaaggtagccgtatcggaaggtgcggctggatcacctcctttctaagga

SEQ ID NO: 8120 - DNA, 1518 bp, Ruminococcus sp. NK3A76
  ref <308>: DATABASE ACCESSION NUMBER: NCBI ACCESSION: NZ_JMMA01000002.1
  ref <309>: DATABASE ENTRY DATE: 2019-04-01
  ref <313>: RELEVANT RESIDUES IN SEQ ID NO: (1)..(1518)
tttaaagagtttgatcctggctcaggacgaacgctggcggcacgcttaacacatgcaagtcgaacggagttttagagagcttgctttttaaaacttagtggcggacgggtgagtaacacgtgagcaatctgcctttcagagggggatagcagttggaaacgactgataataccgcataatatagtaggatcgcatggttcaactatcaaagatttatcgctgaaagatgagctcgcgtctgattagatagttggtgaggtaacggctcaccaagtcgacgatcagtagccggactgagaggttgaacggccacattgggactgagacacggcccagactcctacgggaggcagcagtggggaatattgcacaatgggcgcaagcctgatgcagcgatgccgcgtgagggaagaaggttttaggattgtaaacctctgtcttcagggacgataatgacggtacctgaggaggaagctccggctaactacgtgccagcagccgcggtaatacgtagggagcgagcgttgtccggaattactgggtgtaaagggagtgcaggcgggactgcaagtcagatgtgaaatgtaggggcttaacccctgaactgcatttgaaactgtagttcttgagtgaagtagaggtaagcggaattcctagtgtagcggtgaaatgcgtagatattaggaggaacatcagtggcgaaggcggcttactgggcttttactgacgctgaggctcgaaagcgtggggagcaaacaggattagataccctggtagtccacgctgtaaacgatgattactaggtgtggggggactgaccccttccgtgccgcagttaacacaataagtaatccacctggggagtacggccgcaaggctgaaactcaaaggaattgacgggggcccgcacaagcagtggagtatgtggattaattcgaagcaacgcgaagaaccttaccaggtcttgacatcgtacgcatagcatagagatatgtgaaatcccttcggggacggacagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggcctcacacgtactacaatggctgttaacagagagaagcgacatagtgatatgaagcaaaaccctaaaagcagtctcagttcggattgcaggctgaaacccgcctgcatgaagtcggaattgctagtaatcgcggatcagcatgccgcggtgaatacgttcccgggccttgtacacaccgcccgtcacaccatgggagtcggtaacacccgaagtcagtagcctaaccgtaaggagggcgctgccgaaggtgggattgatgactggggtgaagtcgtaacaaggtagccgtatcggaaggtgcggctggatcacctcctttctatgga

SEQ ID NO: 8121 - DNA, 1431 bp, Ruminococcus sp. OF03-6AA
  ref <308>: DATABASE ACCESSION NUMBER: NCBI ACCESSION: NZ_QTVQ01000103.1
  ref <309>: DATABASE ENTRY DATE: 2019-04-01
  ref <313>: RELEVANT RESIDUES IN SEQ ID NO: (1)..(1431)
ttctagtggcggacgggtgagtaacgcgtgggtaacctgccttgtacagggggataacagtcagaaatgactgctaataccgcataagcgcacaggaccgcatggtccggtgtgaaaaactccggtggtataagatggacccgcgttggattagctagttggcagggtaacggcctaccaagcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggatggacaagtctgatgtgaaaggctggggctcaaccccgggactgcattggaaactgcccgtcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgcggtaaacgatgaatgctaggtgtcgggtgacaaagtcattcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaagtcttgacatccctctgaccggaacttaaccgttccttcccttcggggcagaggagacaggtggtgcatggttgtcgtcagctcgtgtcgtgagatgttgggttaagtcccgcaacgagcgcaacccctatcctcagtagccagcagttcggctgggcactctgtggagactgccagggataacctggaggaaggcggggatgacgtcaaatcatcatgccccttatgatttgggctacacacgtgctacaatggcgtaaacaaagggaagcgaacctgcgagggtgggcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaaccgtaaggagggagctgccgaaggcgggaccgatgactggggtgaagtcgtaacaaggtagccgtatcggaaggtgcggctggatcacctcctttctaaggaa

SEQ ID NO: 8122 - DNA, 1539 bp, Ruminococcus sp. OF05-2BH; identical to SEQ ID NO: 8056
  ref <308>: DATABASE ACCESSION NUMBER: NCBI ACCESSION: NZ_QTZL01000014.1
  ref <309>: DATABASE ENTRY DATE: 2019-04-01
  ref <313>: RELEVANT RESIDUES IN SEQ ID NO: (1)..(1539)

SEQ ID NO: 8123 - DNA, 1539 bp, Ruminococcus sp. OM02-16LB
  ref <308>: DATABASE ACCESSION NUMBER: NCBI ACCESSION: NZ_QVHO01000010.1
  ref <309>: DATABASE ENTRY DATE: 2019-04-01
  ref <313>: RELEVANT RESIDUES IN SEQ ID NO: (1)..(1539)
tttatcagagagtttgatcctggctcaggatgaacgctggcggcgtgcttaacacatgcaagtcgaacgggaaatatttcattgagacttcggtggatttgatctatttctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagctagttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcagagccattcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaaatcttgacatccctctgaccggtctttaatcggaccttctcttcggagcagaggtgacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctcctttctaaggaa

SEQ ID NO: 8124 - DNA, 1020 bp, Ruminococcus sp. OM04-4AA
  ref <308>: DATABASE ACCESSION NUMBER: NCBI ACCESSION: NZ_QTZH01000153.1
  ref <309>: DATABASE ENTRY DATE: 2019-04-01
  ref <313>: RELEVANT RESIDUES IN SEQ ID NO: (1)..(1020)
tttaacgagagtttgatcctggctcaggatgaacgctggcggcgtgcttaacacatgcaagtcgaacgaagcaccttattctgatttcttcggaatgaaaaatttggtgactgagtggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagtggcaagtctgatgtgaaaacccggggctcaaccccgggactgcattggaaactgtcaatctggagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttcct

SEQ ID NO: 8125 - DNA, 1537 bp, Ruminococcus sp. OM05-10BH
  ref <308>: DATABASE ACCESSION NUMBER: NCBI ACCESSION: NZ_QULK01000008.1
  ref <309>: DATABASE ENTRY DATE: 2019-04-01
  ref <313>: RELEVANT RESIDUES IN SEQ ID NO: (1)..(1537)
tttaacgagagtttgatcctggctcaggatgaacgctggcggcgtgcctaacacatgcaagtcgaacgaagcactttctttagattcttcggatgaagaagactgtgactgagtggcggacgggtgagtaacgcgtgggcaacctgccctgtacagggggataacagttagaaatgactgctaataccgcataagcgcacgaggacgcatgttcttgtgtgaaaaactccggtggtacaggatgggcccgcgtctgattaggtagttggtggggcagcggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgaaggaagaagtatttcggtatgtaaacttctatcagcagggaagaaactgacggtacctgactaagaagcaccggctaaatacgtgccagcagccgcggtaatacgtatggtgcaagcgttatccggatttactgggtgtaaagggagcgtagacggagaggcaagtctgaagtgaaagcccggggctcaaccccgggactgctttggaaactgcagttctagagtgccggagaggtaagcggaattcctagtgtagcggtgaaatgcgtagatattaggaggaacaccagtggcgaaggcggcttactggacggtgactgacgttgaggctcgaaagcgtggggagcaaacaggattagataccctggtagtccacgccgtaaacgatgactactaggtgtcggtgagcaaagctcatcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctggccttgacatcccgatgaccggcgtgtaatgacgccttttcttcggaacattggagacaggtggtgcatggttgtcgtcagctcgtgtcgtgagatgttgggttaagtcccgcaacgagcgcaacccttatcttcagtagccagcaattcggttgggcactctggagagactgccagggagaacctggaggaaggtggggatgacgtcaaatcatcatgccccttatggccagggctacacacgtgctacaatggcgtaaacaaagggaagcgagcatgtgagtgtgagcaaatctcaaaaataacgtctcagttcggattgtagtctgcaactcgactacatgaagctggaatcgctagtaatcgcggatcagcatgccgcggtgaatacgttcccgggtcttgtacacaccgcccgtcacaccatgggagtcagtaacgcccgaagccagtgacccaacctataggagggagctgtcgaaggcgggacggataactggggtgaagtcgtaacaaggtagccgtatcggaaggtgcggctggatcacctcctttctaagg

SEQ ID NO: 8126 - DNA, 1517 bp, Ruminococcus sp. OM06-36AC
  ref <308>: DATABASE ACCESSION NUMBER: NCBI ACCESSION: NZ_QSTT01000002.1
  ref <309>: DATABASE ENTRY DATE: 2019-04-01
  ref <313>: RELEVANT RESIDUES IN SEQ ID NO: (1)..(1517)
ttaaataaagagtttgatcctggctcaggacgaacgctggcggcacgcttaacacatgcaagtcgaacggagaacattgagcttgcttaatgttcttagtggcggacgggtgagtaacacgtgagtaacctgcctctgagagtgggatagcttctggaaacggatggtaataccgcataacatcatggattcgcatgtttctatgatcaaagatttatcgcttagagatggactcgcgtctgattagctagttggtaaggtaacggcttaccaaggcgacgatcagtagccggactgagaggttgatcggccacattgggactgagacacggcccagactcctacgggaggcagcagtggggaatattgcacaatgggggaaaccctgatgcagcgatgccgcgtggaggaagaaggttttcggattgtaaactcctgttgaagaggacgataatgacggtactcttttagaaagctccggctaactacgtgccagcagccgcggtaatacgtagggagcgagcgttgtccggaattactgggtgtaaagggagcgtaggcgggatggcaagtcagatgtgaaaactatgggctcaacccatagactgcatttgaaactgttgttcttgagtgaggtagaggtaagcggaattcctggtgtagcggtgaaatgcgtagagatcaggaggaacatcggtggcgaaggcggcttactgggcctttactgacgctgaggctcgaaagcgtggggagcaaacaggattagataccctggtagtccacgccgtaaacgatgattactaggtgtggggggactgaccccttccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatcgagtgacgtacctagagataggtattttcttcggaacacaaagacaggtggtgcatggttgtcgtcagctcgtgtcgtgagatgttgggttaagtcccgcaacgagcgcaacccttaccattagttgctacgcaagagcactctaatgggactgccgttgacaaaacggaggaaggtggggatgacgtcaaatcatcatgccccttatgacctgggctacacacgtactacaatggcaataaaacagagggaagcaatacagcgatgtggagcaaatccccaaaaattgtcccagttcagattgcaggctgcaactcgcctgcatgaagtcggaattgctagtaatcgcagatcagcatgctgcggtgaatacgttcccgggccttgtacacaccgcccgtcacaccatgggagtcggtaacacccaaagccggtcgtctaaccttcgggaggacgccgtctaaggtgggattgatgactggggtgaagtcgtaacaaggtagccgtatcggaaggtgcggctggatcacctcctttctaagga

SEQ ID NO: 8127 - DNA, 1516 bp, Ruminococcus sp. OM07-17
  ref <308>: DATABASE ACCESSION NUMBER: NCBI ACCESSION: NZ_QTZE01000004.1
  ref <309>: DATABASE ENTRY DATE: 2019-04-01
  ref <313>: RELEVANT RESIDUES IN SEQ ID NO: (1)..(1516)
tttaattaagagtttgatcctggctcaggacgaacgctggcggcacgcttaacacatgcaagtcgaacgagagaagagaagcttgcttttctgatctagtggcggacgggtgagtaacacgtgagcaatctgcctttcagagggggataccgattggaaacgatcgttaataccgcataacataattgaaccgcatgatttgattatcaaagatttatcgctgaaagatgagctcgcgtctgattagctagttggtaaggtaacggcttaccaaggcgacgatcagtagccggactgagaggttgatcggccacattgggactgagacacggcccagactcctacgggaggcagcagtggggaatattgcacaatggaggaaactctgatgcagcgatgccgcgtgagggaagaaggttttaggattgtaaacctctgtcttcggggacgaaaaaagacggtacctgaggaggaagctccggctaactacgtgccagcagccgcggtaatacgtagggagcgagcgttgtccggaattactgggtgtaaagggagcgtaggcgggatcgcaagtcagatgtgaaaactatgggcttaacccataaactgcatttgaaactgtggttcttgagtgaagtagaggtaagcggaattcctagtgtagcggtgaaatgcgtagatattaggaggaacatcagtggcgaaggcggcttactgggctttaactgacgctgaggctcgaaagcgtggggagcaaacaggattagataccctggtagtccacgccgtaaacgatgattactaggtgtggggggactgaccccttccgtgccgcagcaaacgcaataagtaatccacctggggagtacgaccgcaaggttgaaactcaaaggaattgacgggggcccgcacaagcagtggagtatgtggattaattcgaagcaacgcgaagaaccttaccaggtcttgacatcgtatgcatagctcagagatgagtgaaatctcttcggagacatatagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggcctcacacgtactacaatggctgtaaacagagggatgcaaagccgcgaggtagagcgaacccctaaaagcagtcttagttcggattgtaggctgcaacccgcctacatgaagtcggaattgctagtaatcgcagatcagcatgctgcggtgaatacgttcccgggccttgtacacaccgcccgtcacgccatgggagtcggtaacacccgaagcctgtagtctaaccgcaaggaggacgcagtcgaaggtgggattgatgactggggtgaagtcgtaacaaggtagccgtatcggaaggtgcggctggatcacctcctttcta

SEQ ID NO: 8128 - DNA, 1521 bp, Ruminococcus sp. OM07-7
  ref <308>: DATABASE ACCESSION NUMBER: NCBI ACCESSION: NZ_QTZD01000016.1
  ref <309>: DATABASE ENTRY DATE: 2019-04-01
  ref <313>: RELEVANT RESIDUES IN SEQ ID NO: (1)..(1521)
ctggctcaggatgaacgctggcggcgtgcttaacacatgcaagtcgaacgaagcaccttggtttgattcttcggatgaagatcttggtgactgagtggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagtggcaagtctgatgtgaaaacccggggctcaaccccgggactgcattggaaactgtcaatctagagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttccttcgggacagggatgacaggtggtgcatggttgtcgtcagctcgtgtcgtgagatgttgggttaagtcccgcaacgagcgcaacccctatctttagtagccagcggttcggccgggcactctagagagactgccagggataacctggaggaaggtggggatgacgtcaaatcatcatgccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 8129 - DNA, 1539 bp, Ruminococcus sp. OM08-13AT; identical to SEQ ID NO: 8056
  ref <308>: DATABASE ACCESSION NUMBER: NCBI ACCESSION: NZ_QTZB01000019.1
  ref <309>: DATABASE ENTRY DATE: 2019-04-01
  ref <313>: RELEVANT RESIDUES IN SEQ ID NO: (1)..(1539)

SEQ ID NO: 8130 - DNA, 1540 bp, Ruminococcus sp. OM08-7
  ref <308>: DATABASE ACCESSION NUMBER: NCBI ACCESSION: NZ_QUKU01000015.1
  ref <309>: DATABASE ENTRY DATE: 2019-04-01
  ref <313>: RELEVANT RESIDUES IN SEQ ID NO: (1)..(1540)
tttatcagagagtttgatcctggctcaggatgaacgctggcggcgtgcttaacacatgcaagtcgaacgggaaatacttcattgagacttcggtggatttgatttatttctagtggcggacgggtgagtaacgcgtgggtaacctgccttatacagggggataacagtcagaaatgactgctaataccgcataagcgcacaggaccgcatggtccggtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcatggccattcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgactcttaaccgagtctttccttcgggacagaggagacaggtggtgcatggttgtcgtcagctcgtgtcgtgagatgttgggttaagtcccgcaacgagcgcaacccctatcctcagtagccagcaagttaagttgggcactctgtggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctcctttctaaggaa

SEQ ID NO: 8131 - DNA, 687 bp, Ruminococcus sp. TF06-23
  ref <308>: DATABASE ACCESSION NUMBER: NCBI ACCESSION: NZ_QUKR01000138.1
  ref <309>: DATABASE ENTRY DATE: 2019-04-01
  ref <313>: RELEVANT RESIDUES IN SEQ ID NO: (1)..(687)
gcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcagagccattcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaa

SEQ ID NO: 8132 - DNA, 1539 bp, Ruminococcus sp. TF10-12AC
  ref <308>: DATABASE ACCESSION NUMBER: NCBI ACCESSION: NZ_QTYX01000014.1
  ref <309>: DATABASE ENTRY DATE: 2019-04-01
  ref <313>: RELEVANT RESIDUES IN SEQ ID NO: (1)..(1539)
tttaacgagagtttgatcctggctcaggatgaacgctggcggcgtgcttaacacatgcaagtcgaacgaagcaccttgattcgattcttcggatgaagattttggtgactgagtggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagtggcaagtctgatgtgaaaacccggggctcaaccccgggactgcattggaaactgtcaatctagagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttccttcgggacagggatgacaggtggtgcatggttgtcgtcagctcgtgtcgtgagatgttgggttaagtcccgcaacgagcgcaacccctatctttagtagccagcggtttggccgggcactctagagagactgccagggataacctggaggaaggtggggatgacgtcaaatcatcatgccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 8133 - DNA, 1521 bp, Ruminococcus sp. TF10-6
  ref <308>: DATABASE ACCESSION NUMBER: NCBI ACCESSION: NZ_QUSO01000015.1
  ref <309>: DATABASE ENTRY DATE: 2019-04-01
  ref <313>: RELEVANT RESIDUES IN SEQ ID NO: (1)..(1521)
ctggctcaggatgaacgctggcggcgtgcttaacacatgcaagtcgaacgaagcaccttgattcgattcttcggatgaagatcttggtgactgagtggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattaggtagttggtggggtaacggcctaccaagccgacgatcagtagccgacctgagagggtgaccggccacattgggactgagacacggcccaaactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggagtggcaagtctgatgtgaaaacccggggctcaaccccgggactgcattggaaactgtcaatctagagtaccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgactactaggtgtcgggcagcaaagctgttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttccttcgggacagggatgacaggtggtgcatggttgtcgtcagctcgtgtcgtgagatgttgggttaagtcccgcaacgagcgcaacccctatctttagtagccagcggtttggccgggcactctagagagactgccagggataacctggaggaaggtggggatgacgtcaaatcatcatgccccttatgagcagggctacacacgtgctacaatggcgtaaacaaagggaggcagaaccgcgaggtcgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 8134 - DNA, 1539 bp, Ruminococcus sp. TF11-2AC
  ref <308>: DATABASE ACCESSION NUMBER: NCBI ACCESSION: NZ_QUKI01000013.1
  ref <309>: DATABASE ENTRY DATE: 2019-04-01
  ref <313>: RELEVANT RESIDUES IN SEQ ID NO: (1)..(1539)
ttaatcagagagtttgatcctggctcaggatgaacgctggcggcgtgcttaacacatgcaagtcgaacgggaaatatttcattgagacttcggtggatttgatctatttctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagctggttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagatcgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctcctttctaaggaa

SEQ ID NO: 8135 - DNA, 1539 bp, Ruminococcus sp. TF12-19AC
  ref <308>: DATABASE ACCESSION NUMBER: NCBI ACCESSION: NZ_QTYV01000005.1
  ref <309>: DATABASE ENTRY DATE: 2019-04-01
  ref <313>: RELEVANT RESIDUES IN SEQ ID NO: (1)..(1539)
aaattttagagagtttgatcctggctcaggacgaacgctggcggcgtgcctaacacatgcaagtcgaacggaactgttttgaaagatttcttcggaatgaatttgatttagtttagtggcggacgggtgagtaacgcgtgagtaacctgccttcaagagggggataacattctgaaaagaatgctaataccgcatgatatatcggaatcacatgattttgatatcaaagattttatcgcttgaagatggactcgcgtccgattagttagttggtgaggtaacggctcaccaagaccgcgatcggtagccggactgagaggttgaacggccacattgggactgagacacggcccagactcctacgggaggcagcagtgggggatattgcgcaatgggggcaaccctgacgcagcaacgccgcgtgaaggatgaaggttttcggattgtaaacttcttttattaaggacgaaacttgacggtacttaatgaataagctccggctaactacgtgccagcagccgcggtaatacgtagggagcaagcgttgtccggatttactgggtgtaaagggtgcgtaggcggctttgcaagtcagatgtgaaatctatgggctcaacccataaactgcatttgaaactgtagagcttgagtgaagtagaggcaggcggaattccccgtgtagcggtgaaatgcgtagagatggggaggaacaccagtggcgaaggcggcctgctgggctttaactgacgctgaggcacgaaagcgtgggtagcaaacaggattagataccctggtagtccacgctgtaaacgatgattactaggtgtggggggtctgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccaactaacgaagtagagatacattaggtgcccttcggggaaagttgagacaggtggtgcatggttgtcgtcagctcgtgtcgtgagatgttgggttaagtcccgcaacgagcgcaacccttgctattagttgctacgcaagagcactctaataggactgccgttgacaaaacggaggaaggtggggacgacgtcaaatcatcatgccccttatgacctgggctacacacgtactacaatggatgttaacagagggaagcaagacagcgatgtggagcaaacccctaaaaacattctcagttcagattgcaggctgcaacccgcctgcatgaagatggaattgctagtaatcgcggatcagcatgccgcggtgaatacgttcccgggccttgtacacaccgcccgtcacaccatgggagccggtaatacccgaagtcagtagtccaacctcgtgaggacgctgccgaaggtaggattggcgactggggtgaagtcgtaacaaggtagccgtatcggaaggtgcggctggatcacctcctttctatgga

SEQ ID NO: 8136 - DNA, 1516 bp, Ruminococcus sp. TF12-2; identical to SEQ ID NO: 8127
  ref <308>: DATABASE ACCESSION NUMBER: NCBI ACCESSION: NZ_QTYU01000004.1
  ref <309>: DATABASE ENTRY DATE: 2019-04-01
  ref <313>: RELEVANT RESIDUES IN SEQ ID NO: (1)..(1516)

SEQ ID NO: 8137 - DNA, 1414 bp, Ruminococcus sp. TM09-4
  ref <308>: DATABASE ACCESSION NUMBER: NCBI ACCESSION: NZ_QUKB01000094.1
  ref <309>: DATABASE ENTRY DATE: 2019-04-01
  ref <313>: RELEVANT RESIDUES IN SEQ ID NO: (1)..(1414)
gagtaacgcgtgggtaacctgccttatacagggggataacagtcagaaatggctgctaataccgcataagcgcacagagctgcatggctcagtgtgaaaaactccggtggtataagatggacccgcgttggattagctagttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctcctttctaaggaa

SEQ ID NO: 8138 - DNA, 1540 bp, Ruminococcus sp. TM10-9AT; identical to SEQ ID NO: 8130
  ref <308>: DATABASE ACCESSION NUMBER: NCBI ACCESSION: NZ_QSNZ01000015.1
  ref <309>: DATABASE ENTRY DATE: 2019-04-01
  ref <313>: RELEVANT RESIDUES IN SEQ ID NO: (1)..(1540)

SEQ ID NO: 8139 - DNA, 1421 bp, Ruminococcus sp. YE71
  ref <308>: DATABASE ACCESSION NUMBER: NCBI ACCESSION: NZ_FPIR01000043.1
  ref <309>: DATABASE ENTRY DATE: 2019-04-01
  ref <313>: RELEVANT RESIDUES IN SEQ ID NO: (1)..(1421)
ggatcagtggcggacgggtgagtaacacgtgagcaatctgcctttaagaggggaataacgactggaaacggtcggtaataccgcataacatatcgaagccgcatgactttgatatcaaagatttatcgcttaaagatgagctcgcgtctgattagctagttggtgaggtaacggcccaccaaggcgacgatcagtagccggactgagaggttgaacggccacattgggactgagacacggcccagactcctacgggaggcagcagtggggaatattgcacaatgggcgcaagcctgatgcagcgatgccgcgtgagggaagaaggttttcggattgtaaacctctgttgacagggacgataatgacggtacctgttcagaaagctccggctaactacgtgccagcagccgcggtaatacgtagggagcgagcgttgtccggaattactgggtgtaaagggagtgtaggcgggactgcaagtcagatgtgaaatgtaggggctcaacccctgacctgcatttgaaactgtagttcttgagtgaagtagaggtaagcggaattcccagtgtagcggtgaaatgcgtagatattgggaggaacatcagtggcgaaggcggcttactgggctttaactgacgctgaggctcgaaagcgtggggagcaaacaggattagataccctggtagtccacgccgtaaacgatgattactaggtgtggggggattgaccccttccgtgccgcagttaacacaataagtaatccacctggggagtacggtcgcaagactgaaactcaaaggaattgacgggggcccgcacaagcagtggagtatgtggattaattcgaagcaacgcgaagaaccttaccaggtcttgacatcgtacgcatagtgtagagatacatgaagtccttcgggacgtatagacaggtggtgcatggttgtcgtcagctcgtgtcgtgagatgttgggttaagtcccgcaacgagcgcaacccttactgttagttgctacgcaagagcactctagcaggactgccgttgacaaaacggaggaaggtggggatgacgtcaaatcatcatgccccttatgacctgggcctcacacgtactacaatggctgttaacagagggaagcgaagccgcgaggtggagcaaatccccaaaagcagtcttagttcggattgtaggctgcaacccgcctacatgaagtcggaattgctagtaatcgcagatcagcatgctgcggtgaatacgttcccgggccttgtacacaccgcccgtcacaccatgggagttggtaacacccgaagtcagtagcctaaccgcaaggagggcgctgccgaaggtgggatcgatgactggggtgaagtcgtaacaaggtagccgtatcggaaggtgcggctggatcacctcctttcta

SEQ ID NO: 8140 - DNA, 1558 bp, Rummeliibacillus pycnus
  ref <308>: DATABASE ACCESSION NUMBER: NCBI ACCESSION: NZ_KZ614145.1
  ref <309>: DATABASE ENTRY DATE: 2019-04-01
  ref <313>: RELEVANT RESIDUES IN SEQ ID NO: (1)..(1558)
tttatggagagtttgatcctggctcaggacgaacgctggcggcgtgcctaatacatgcaagtcgagcgaatgacgaggagcttgctcctctgatttagcggcggacgggtgagtaacacgtgggcaacctgccctgtagactgggataacttcgggaaaccggagctaataccagataatccatttcacctcatggtgaaatgttgaaaggcgctttcgggcgtcactacaggatgggcccgcggtgcattagctagttggtggggtaacggcctaccaaggcgacgatgcatagccgacctgagagggtgatcggccacattgggactgagacacggcccaaactcctacgggaggcagcagtagggaatcttccacaatggacgaaagtctgatggagcaacgccgcgtgagtgatgaaggttttcggatcgtaaaactctgttgtaagggaagaacaagtacgttaggaaatgaacgtaccttgacggtaccttattagaaagccacggctaactacgtgccagcagccgcggtaatacgtaggtggcaagcgttgtccggatttattgggcgtaaagcgcgcgcaggcggtttcttaagtctgatgtgaaagcccacggcttaaccgtggagggtcattggaaactgggagacttgagtgcagaagaggaaagtggaattccaagtgtagcggtgaaatgcgtagagatttggaggaacaccagtggcgaaggcgactttctggtctgcaactgacgctgaggcgcgaaagcatggggagcaaacaggattagataccctggtagtccatgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccagtgaccactctagagatagagttttcccttcggggacattggtgacaggtggtgcatggttgtcgtcagctcgtgtcgtgagatgttgggttaagtcccgcaacgagcgcaacccttaatcttagttgccatcatttagttgggcactctaaggtgactgccggtgacaaaccggaggaaggtggggatgacgtcaaatcatcatgccccttatgacctgggctacacacgtgctacaatggacggtacaaagagtcgctaactcgcgagagcacgctaatctcataaaaccgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggatagatgattggggtgaagtcgtaacaaggtagccgtatcggaaggtgcggctggatcacctcctttctaaggaa

SEQ ID NO: 8141 - DNA, 1551 bp, Rummeliibacillus sp. POC4
  ref <308>: DATABASE ACCESSION NUMBER: NCBI ACCESSION: NZ_QWUA01000115.1
  ref <309>: DATABASE ENTRY DATE: 2019-04-01
  ref <313>: RELEVANT RESIDUES IN SEQ ID NO: (1)..(1551)
tttatggagagtttgatcctggctcaggacgaacgctggcggcgtgcctaatacatgcaagtcgagcgaatgacgagaagcttgcttctctgatttagcggcggacgggtgagtaacacgtgggcaacctgccctgtagactgggataacttcgggaaaccggagctaataccggataatccatttcacctcatggtgaaatgttaaaaggcgcatctcgcgtcactacaggatgggcccgcggtgcattagctagttggtggggtaacggcctaccaaggcaacgatgcatagccgacctgagagggtgatcggccacattgggactgagacacggcccaaactcctacgggaggcagcagtagggaatcttccacaatggacgaaagtctgatggagcaacgccgcgtgagtgatgaaggttttcggatcgtaaaactctgttgtaagggaagaacaagtacgttaggaaatgaacgtaccttgacggtaccttattagaaagccacggctaactacgtgccagcagccgcggtaatacgtaggtggcaagcgttgtccggatttattgggcgtaaagcgcgcgcaggcggtttcttaagtctgatgtgaaagcccacggcttaaccgtggagggtcattggaaactgggagacttgagtgcagaagaggaaagtggaattccaagtgtagcggtgaaatgcgtagagatttggaggaacaccagtggcgaaggcgactttctggtctgcaactgacgctgaggcgcgaaagcatggggagcaaacaggattagataccctggtagtccatgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccagtgaccactctagagatagagttttcccttcggggacattggtgacaggtggtgcatggttgtcgtcagctcgtgtcgtgagatgttgggttaagtcccgcaacgagcgcaacccttgatcttagttgccatcattcagttgggcactctaaggtgactgccggtgacaaaccggaggaaggtggggatgacgtcaaatcatcatgccccttatgacctgggctacacacgtgctacaatggacggtacaaagagtcgctaactcgcgagagtacgctaatctcataaaaccgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggggccagccgccgaaggtgggatagatgattggggtgaagtcgtaacaaggtagccgtatcggaaggtgcggctggatcacctcctttct

SEQ ID NO: 8142 - DNA, 1548 bp, Rummeliibacillus sp. TYF-LIM-R05
  ref <308>: DATABASE ACCESSION NUMBER: NCBI ACCESSION: NZ_QXII01000003.1
  ref <309>: DATABASE ENTRY DATE: 2019-04-01
  ref <313>: RELEVANT RESIDUES IN SEQ ID NO: (1)..(1548)
tggagagtttgatcctggctcaggacgaacgctggcggcgtgcctaatacatgcaagtcgagcggacagatgggagcttgctccctgatgtcagcggcggacgggtgagtaacacgtgggtaacctgcctgtaagactgggataactccgggaaaccggggctaataccggatgcttgattgaaccgcatggttcaattataaaaggtggcttttagctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttct

SEQ ID NO: 8143 - DNA, 1310 bp, Rummeliibacillus sp. TYF005
  ref <308>: DATABASE ACCESSION NUMBER: NCBI ACCESSION: NZ_ML122618.1
  ref <309>: DATABASE ENTRY DATE: 2019-04-01
  ref <313>: RELEVANT RESIDUES IN SEQ ID NO: (1)..(1310)
gcgtcactacaggatgggcccgcggtgcattagctagttggtggggtaacggcctaccaaggcaacgatgcatagccgacctgagagggtgatcggccacattgggactgagacacggcccaaactcctacgggaggcagcagtagggaatcttccacaatggacgaaagtctgatggagcaacgccgcgtgagtgatgaaggttttcggatcgtaaaactctgttgtaagggaagaacaagtacgttaggaaatgaacgtaccttgacggtaccttattagaaagccacggctaactacgtgccagcagccgcggtaatacgtaggtggcaagcgttgtccggatttattgggcgtaaagcgcgcgcaggcggtttcttaagtctgatgtgaaagcccacggcttaaccgtggagggtcattggaaactgggagacttgagtgcagaagaggaaagtggaattccaagtgtagcggtgaaatgcgtagagatttggaggaacaccagtggcgaaggcgactttctggtctgcaactgacgctgaggcgcgaaagcatggggagcaaacaggattagataccctggtagtccatgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaatctagagatagagttttcccttcggggacattggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacggtacaaagagtcgctaactcgcgagagtacgctaatctcataaaaccgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggggccagccgccgaaggtgggatagatgattggggtgaagtcgtaacaaggtagccgtatcggaaggtgcggctggatcacctcctttct

SEQ ID NO: 8144 - DNA, 1557 bp, Rummeliibacillus stabekisii
  ref <308>: DATABASE ACCESSION NUMBER: NCBI ACCESSION: NZ_CP014806.1
  ref <309>: DATABASE ENTRY DATE: 2019-04-01
  ref <313>: RELEVANT RESIDUES IN SEQ ID NO: (1)..(1557)
ttttatggagagtttgatcctggctcaggacgaacgctggcggcgtgcctaatacatgcaagtcgagcgaatgacgaggagcttgctcctctgatttagcggcggacgggtgagtaacacgtgggcaacctgccctgcagactgggataacttcgggaaaccggagctaataccggataatccattttacttcatggtgaaatgttgaaaggcgctttcgcgccactgcaggatgggcccgcggtgcattagctagttggtggggtaacggcctaccaaggcgacgatgcatagccgacctgagagggtgatcggccacattgggactgagacacggcccaaactcctacgggaggcagcagtagggaatcttccacaatggacgaaagtctgatggagcaacgccgcgtgagtgatgaaggttttcggatcgtaaaactctgttgtaagggaagaacaagtacgttaggaaatgaacgtaccttgacggtaccttattagaaagccacggctaactacgtgccagcagccgcggtaatacgtaggtggcaagcgttgtccggatttattgggcgtaaagcgcgcgcaggtggtttcttaagtctgatgtgaaatctcgcggctcaaccgcgagcggtcattggaaactggggaacttgagtgcagaagaggatagtggaattccaagtgtagcggtgaaatgcgtagagatttggaggaacaccagtggcgaaggcgactgtctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccagtgaccgctctagagatagagttttcccttcggggacattggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacggtacaaagagtcgcaaactcgcgagagcaagctaatctcataaaaccgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggggccagccgccgaaggtgggatagatgattggggtgaagtcgtaacaaggtagccgtatcggaaggtgcggctggatcacctcctttctaaggaa

SEQ ID NO: 8145 - DNA, 1515 bp, Runella limosa
  ref <308>: DATABASE ACCESSION NUMBER: NCBI ACCESSION: NZ_AXVJ01000103.1
  ref <309>: DATABASE ENTRY DATE: 2019-04-01
  ref <313>: RELEVANT RESIDUES IN SEQ ID NO: (1)..(1515)
tttacgatggagagtttgatcctggctcaggatgaacgctagcggcaggcctaatacatgcaagactagggggcagcaatgtcaccgtcgcacgggtgcgtaacgcgtatgcaacctacctatcacagggggatagcctttggaaacagggattaataccgcatgatactattggatagcattatttaatagttaaagatttattggtgatagatgggcatgcgtctgattagttagatggtggggtaacggcctaccatgacgatgatcagtagggggcgtcagagcgtggtcccccacactggcactgagatacgggccagactcctacgggaggcagcagtagggaatattgggcaatggatgcaagtctgacccagccatgccgcgtgcaggaagaaggtcctctggattgtaaactgcttttttgggggaagaagagacatcttgcgaggtgttgtgacggtaccctaagaataagccacggctaactacgtgccagcagccgcggtaatacgtaggtggcaagcgttgtccggatttattgggtttaaagggtgcgtaggtggtttgataagtcagtggtgaaagatgattgctcaacaatcaaactgccattgatactgttagacttgagagaagtggaggctggtggaatggatggtgtagcggtgaaatgcatagatatcatccagaacgtcaattgcgaaggcagctggctgtactttttctgacactgaggcacgaaagtgtggggatcaaacaggattagataccctggtagtccacactgtaaacgatgcgaactagctttttggctgtaaagttgagaggctaagggaaaccgataagttcgccacctggggagtacgccggcaacggtgaaactcaaaggaattgacgggggtccgcacaagcggtggagcatgtggtttaattcgatgatacgcgaggaaccttacctgggctaaatcacaatagaatttagcagagatgttagagctagcaatagctgttgtgaaggtgctgcatggctgtcgtcagctcgtgccgtgaggtgttgggttaagtcccgcaacgagcgcaacccctggggatagttgctaacaggttaagctgaggactctattccaactgcctgcgcaagcagagaggaaggaggggacgacgtcaagtcatcatggcccttacgtccagggctacacacgtgctacaatggcatatacagagtgttgcgagccagcgatggtaagccaatcacaaaaagtatgtcacagttcggattgcaggctgcaactcgcctgtatgaagctggaatcgctagtaatcgcgtatcagcaatgacgcggtgaatacgttcccggaccttgtacacaccgcccgtcaagccatggaagtcggggagacctaaagcggaaggtaacatacttcgttagggtaaatctggtaactggggctaagtcgtaacaaggtagccgtaccggaaggtgtggctggaacacctcctttctggag

SEQ ID NO: 8146 - DNA, 1510 bp, Runella slithyformis
  ref <308>: DATABASE ACCESSION NUMBER: NCBI ACCESSION: NC_015703.1
  ref <309>: DATABASE ENTRY DATE: 2019-04-01
  ref <313>: RELEVANT RESIDUES IN SEQ ID NO: (1)..(1510)
tttacgatggagagtttgatcctggctcaggatgaacgctagcggcaggcctaatacatgcaaggcgaaggggcagcaatgtcactgtcgtacgggtgcgtaacgcgtatgcaacctacctatcacaggggaatagcctttggaaacagggattaataccgcataaagcaggggctccgcatggagatattgctaaagatttatcggtgatagatgggcatgcgtctgattagttagttggcagggtaacggcctaccaagacgatgatcagtagggggcgtcagagcgtggtcccccacactggcactgagatacgggccagactcctacgggaggcagcagtagggaatattgggcaatggatgcaagtctgacccagccatgccgcgtgcaggaagaaggtcctctggattgtaaactgcttttatcggggaagaataggtctcttgcgagggattgtgacggtacccgatgaataagccacggctaactacgtgccagcagccgcggtaatacgtaggtggcaagcgttgtccggatttattgggtttaaagggtgcgtaggtggttttataagtcagtggtgaaagctggttgctcaacaatcaagttgccattgatactgttagacttgagagaagtggaggttcatggaatggatggtgtagcggtgaaatgcatagatatcatccagaacgtcgattgcgaaggcagtgggctgtactttttctgacactgaggcacgaaagcgtggggatcaaacaggattagataccctggtagtccacgctgtaaacgatgcgaactagctttcgggtttaagattcgggggctaagggaaaccgataagttcgccacctggggagtacgccggcaacggtgaaactcaaaggaattgacgggggtccgcacaagcggtggagcatgtggtttaattcgatgatacgcgaggaaccttacctgggctaaatcatacacgagtcattcagagatgagtgagccagcaatggcgggtatgaaggtgctgcatggctgtcgtcagctcgtgccgtgaggtgttgggttaagtcccgcaacgagcgcaacccctgggaatagttgctaacaggttaagctgaggactctatttcaactgcctgcgcaagcagagaggaagggggggacgacgtcaagtcatcatggcccttacgtccagggctacacacgtgctacaatggcgtgtacagagtgttgcgaggcagcgatgccaagccaatcactaaaagcacgtcacagttcggattgcaggctgcaactcgcctgtatgaagctggaatcgctagtaatcgcgtatcagcaatgacgcggtgaatacgttcccggaccttgtacacaccgcccgtcaagccatggaagtcggggagacctaaagcggaaggttaaagacttcgttagggtaaatctggtaactggggctaagtcgtaacaaggtagccgtaccggaaggtgtggctggaacacctcctttct

SEQ ID NO: 8147 - DNA, 1511 bp, Runella sp. SP2
  ref <308>: DATABASE ACCESSION NUMBER: NCBI ACCESSION: NZ_CP031030.1
  ref <309>: DATABASE ENTRY DATE: 2019-04-01
  ref <313>: RELEVANT RESIDUES IN SEQ ID NO: (1)..(1511)
tttacgatggagagtttgatcctggctcaggatgaacgctagcggcaggcctaatacatgcaagactagggggcagcaatgtcaccgtcgcacgggtgcgtaacgcgtatgcaacctacctatcacagggggatagcctttggaaacagggattaataccgcataaagcaggggctccgcatggagatattgctaaagatttatcggtgatagatgggcatgcgtctgattagttagatggtggggtaacggcctaccatggcgatgatcagtagggggcgtcagagcgtggtcccccacactggcactgagatacgggccagactcctacgggaggcagcagtagggaatattgggcaatggatgcaagtctgacccagccatgccgcgtgcaggaagaaggtcctctggattgtaaactgcttttttgggggaagaagagacaccttgcgaggtgttgtgacggtaccctaagaataagccacggctaactacgtgccagcagccgcggtaatacgtaggtggcaagcgttgtccggatttattgggtttaaagggtgcgtaggtggtttaataagtcagtggtgaaagctggttgctcaacaatcaagttgccattgatactgttagacttgagagaagtggaggctggtggaatggatggtgtagcggtgaaatgcatagatatcatccagaacgtcaattgcgaaggcagctggctgtactttttctgacactgaggcacgaaagtgtggggatcaaacaggattagataccctggtagtccacactgtaaacgatgcgaactagctttttgtctttaaggttgagaggctaagggaaaccgataagttcgccacctggggagtacgccggcaacggtgaaactcaaaggaattgacgggggtccgcacaagcggtggagcatgtggtttaattcgatgatacgcgaggaaccttacctgggctaaatcacaatagaattcttcagagatggaggagctagcaatagctgttgtgaaggtgctgcatggctgtcgtcagctcgtgccgtgaggtgttgggttaagtcccgcaacgagcgcaacccctggggatagttgctaacaggttaagctgaggactctattccaactgcctgcgcaagcagagaggaaggaggggacgacgtcaagtcatcatggcccttacgtccagggctacacacgtgctacaatggcatgtacagagtgttgcgagccagcgatggtaagccaatcacaaaaagcatgtcacagttcggattgcaggctgcaactcgcctgtatgaagctggaatcgctagtaatcgcgtatcagcaatgacgcggtgaatacgttcccggaccttgtacacaccgcccgtcaagccatggaagtcggggagacctaaagcggaaggtaaaagatttcgttagggtaaatctggtaactggggctaagtcgtaacaaggtagccgtaccggaaggtgtggctggaacacctcctttct

SEQ ID NO: 8148 - DNA, 1265 bp, Runella zeae
  ref <308>: DATABASE ACCESSION NUMBER: NCBI ACCESSION: NZ_AUIF01000105.1
  ref <309>: DATABASE ENTRY DATE: 2019-04-01
  ref <313>: RELEVANT RESIDUES IN SEQ ID NO: (1)..(1265)
ggctcaccaagacgatgatcagtagggggcgtcagagcgtggtcccccacactggcactgagatacgggccagactcctacgggaggcagcagtagggaatattgggcaatggatgcaagtctgacccagccatgccgcgtgcaggaagaaggtcctctggattgtaaactgcttttttgggggaagaatagttttcttgcgaggaaatgtgacggtaccctaagaataagccacggctaactacgtgccagcagccgcggtaatacgtaggtggcaagcgttgtccggatttattgggtttaaagggtgcgtaggtggtttgataagtcagtggtgaaagccggttgctcaacaatcgagttgccattgatactgtcggacttgagagaagtggaggttcatggaatggatggtgtagcggtgaaatgcatagatatcatccagaacgtcgattgcgaaggcagtgggctgtactttatctgacactgaggcacgaaagtgtggggatcaaacaggattagataccctggtagtccacactgtaaacgatgcgaactagctttttggtttttggattgggaggctaagggaaaccgataagttcgccacctggggagtacgccggcaacggtgaaactcaaaggaattgacgggggtccgcacaagcggtggagcatgtggtttaattcgatgatacgcgaggaaccttacctgggctaaatcagatatgaatttagcagagatgttagagccagcaatggcatatttgaaggtgctgcatggctgtcgtcagctcgtgccgtgaggtgttgggttaagtcccgcaacgagcgcaacccttggggatagttgctaacaggtaaagctgaggactctatttcaactgcctgcgcaagcagagaggaaggaggggacgacgtcaagtcatcatggcccttacgtccagggctacacacgtgctacaatggcgtgtacagagtgttgcgaggtggtgacactgagccaatcactaaaagcacgtcacagttcggattgcaggctgcaactcgcctgtatgaagctggaatcgctagtaatcgcgcatcagcaatggcgcggtgaatacgttcccggaccttgtacacaccgcccgtcaagccatggaagtcggggagacctaaagcggaaggtaaaagatttcgttagggtaaatctggtaactggggctaagtcgtaacaaggtagccgtaccggaaggtgtggctggaacacctcctttctggag

SEQ ID NO: 8149 - DNA, 1532 bp, Ruthenibacterium lactatiformans
  ref <308>: DATABASE ACCESSION NUMBER: NCBI ACCESSION: NZ_LMUA01000058.1
  ref <309>: DATABASE ENTRY DATE: 2019-04-01
  ref <313>: RELEVANT RESIDUES IN SEQ ID NO: (1)..(1532)
tttaatgaagagtttgatcctggctcaggacgaacgctggcggcgcgcctaacacatgcaagtcgaacggagctgttttctctgaagttttcggatggaagagagttcagcttagtggcgaacgggtgagtaacacgtgagcaacctgcctttcagtgggggacaacatttggaaacgaatgctaataccgcataagaccacagtgtcgcatggcacaggggtcaaaggatttatccgctgaaagatgggctcgcgtccgattagctagatggtgaggtaacggcccaccatggcgacgatcggtagccggactgagaggttgaacggccacattgggactgagacacggcccagactcctacgggaggcagcagtggggaatattgcacaatgggggaaaccctgatgcagcgacgccgcgtggaggaagaaggtcttcggattgtaaactcctgtcccaggggacgataatgacggtaccctgggaggaagcaccggctaactacgtgccagcagccgcggtaaaacgtagggtgcaagcgttgtccggaattactgggtgtaaagggagcgcaggcggattggcaagttgggagtgaaatctatgggctcaacccataaattgctttcaaaactgtcagtcttgagtggtgtagaggtaggcggaattcccggtgtagcggtggaatgcgtagatatcgggaggaacaccagtggcgaaggcggcctactgggcactaactgacgctgaggctcgaaagcatgggtagcaaacaggattagataccctggtagtccatgccgtaaacgatgattactaggtgtgggaggattgaccccttccgtgccgcagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatcggatgcatacctaagagattagggaagtccttcgggacatccagacaggtggtgcatggttgtcgtcagctcgtgtcgtgagatgttgggttaagtcccgcaacgagcgcaacccttatcgttagttactacgcaagaggactctaacgagactgccgttgacaaaacggaggaaggtggggatgacgtcaaatcatcatgccctttatgacctgggctacacacgtactacaatggctattaacagagagaagcgataccgcgaggtggagcaaacctcacaaaaatagtctcagttcggatcgcaggctgcaacccgcctgcgtgaagccggaattgctagtaatcgcggatcagcatgccgcggtgaatacgttcccgggccttgtacacaccgcccgtcacaccatgagagccggggggacccgaagtcggtagtctaaccgtaaggaggacgccgccgaaggtaaaactggtgattggggtgaagtcgtaacaaggtagccgtatcggaaggtgcggctggatcacctcctttcta

SEQ ID NO: 8150 - DNA, 204 bp, Saccharibacillus kuerlensis
  ref <308>: DATABASE ACCESSION NUMBER: NCBI ACCESSION: NZ_KB899277.1
  ref <309>: DATABASE ENTRY DATE: 2019-04-01
  ref <313>: RELEVANT RESIDUES IN SEQ ID NO: (1)..(204)
ctttaatggagagtttgatcctggctcaggacgaacgctggcggcatgcctaatacatgcaagtcgagcggagtaaggtggaacttgttccaccgaacttagcggcggacgggtgagtaacacgtaggcaacctgcctttcagccctgggataacttccggaaacggatgctaataccggatacatcattttctggcatcagag

SEQ ID NO: 8151 - DNA, 1558 bp, Saccharibacillus sacchari
  ref <308>: DATABASE ACCESSION NUMBER: NCBI ACCESSION: NZ_KK073875.1
  ref <309>: DATABASE ENTRY DATE: 2019-04-01
  ref <313>: RELEVANT RESIDUES IN SEQ ID NO: (1)..(1558)
tggagagtttgatcctggctcaggacgaacgctggcggcatgcctaatacatgcaagtcgagcggactaaggtgaaacttgtttcaccgaggttagcggcggacgggtgagtaacacgtaggcaacctgcctttcagtttgggataacttccggaaacggatgctaataccgaatacatcatcttccggcatcggaggatgaggaaagacggcgcaagctgtcactgagagatgggcctgcggcgcattagctagttggtggggtaacggctcaccaaggcgacgatgcgtagccgacctgagagggtgaacggccacactgggactgagacacggcccagactcctacgggaggcagcagtagggaatcttccacaatgggcgaaagcctgatggagcaatgccgcgtgagtgatgaaggttttcggatcgtaaagctctgttgccagggaagaacgtccgggtgagtaactgcacccggagtgacggtacctgagaagaaagccccggctaactacgtgccagcagccgcggtaatacgtagggggcaagcgttgtccggaattattgggcgtaaagcgcgtgcaggcggcttgttaagtcggatgtttaagatcggggctcaaccccgattcgcatccgaaactggcaagcttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgagtgctaggtgttcggggtttcgataccctgggtgccgaagttaacgcattaagcactccgcctggggagtacggtcgcaagactgaaactcaaaggaattgacggggacccgcacaagcagtggagtatgtggtttaattcgaagcaacgcgaagaaccttaccaagtcttgacatcggcatgaccggcttagagataggcctttccttcgggacatgccagacaggtggtgcatggttgtcgtcagctcgtgtcgtgagatgttgggttaagtcccgcaacgagcgcaacccttgactttagttgccagcattttaagatgggcactctagagtgactgccggtgacaaaccggaggaaggcggggatgacgtcaaatcatcatgccccttatgacttgggctacacacgtactacaatggccggtacagagggtcgcgaagccgcgaggtgaagccaatcccagaaagccggtctcagttcggattgtaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaacctgcaaaggagccagccgccgaaggtggggtagatgattggggtgaagtcgtaacaaggtagccgtatcggaaggtgcggctggatcacctcctttctatggaga

SEQ ID NO: 8152 - DNA, 1559 bp, Saccharibacillus sp. O16
  ref <308>: DATABASE ACCESSION NUMBER: NCBI ACCESSION: NZ_NIOB01000020.1
  ref <309>: DATABASE ENTRY DATE: 2019-04-01
  ref <313>: RELEVANT RESIDUES IN SEQ ID NO: (1)..(1559)
tggagagtttgatcctggctcaggacgaacgctggcggcatgcctaatacatgcaagtcgagcggactagatgaagaagcttgcttcttctgacggttagcggcggacgggtgagtaacacgtaggcaacctgcctttcagtttgggataacttccggaaacggatgctaataccgaatacatcatcttctggcatcagagaatgaggaaagacggcgcaagctgtcactgagagatgggcctgcggcgcattagctagttggtggggtaatggctcaccaaggcgacgatgcgtagccgacctgagagggtgaacggccacactgggactgagacacggcccagactcctacgggaggcagcagtagggaatcttccacaatgggcgaaagcctgatggagcaatgccgcgtgagtgatgaaggttttcggatcgtaaagctctgttgccagggaagaacgtccaggtgagtaactgcacctggagtgacggtacctgagaagaaagccccggctaactacgtgccagcagccgcggtaatacgtagggggcaagcgttgtccggaattattgggcgtaaagcgcgtgcaggcggctttttaagttgggtgtttaagaccggggctcaaccccggctcgcacccaaaactgggaagcttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgagtgctaggtgttcggggtttcgataccctgggtgccgaagttcacgcattaagcactccgcctggggagtacggccgcaaggctgaaactcaaaggaattgacggggacccgcacaagcagtggagtatgtggtttaattcgaagcaacgcgaagaaccttaccaggtcttgacatccctctgaccggtctagagatagaccttcccttcggggcagaggagacaggtggtgcatggttgtcgtcagctcgtgtcgtgagatgttgggttaagtcccgcaacgagcgcaacccttgactttagttgccagcatttcggatgggcactctagagtgactgccggtgacaaaccggaggaaggcggggatgacgtcaaatcatcatgccccttatgacctgggctacacacgtactacaatggccggtacagagggctgcgaagccgcgaggtggagccaatcccagaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctatggaga

SEQ ID NO: 8153 - DNA, 1393 bp, Saccharibacillus sp. O23
  ref <308>: DATABASE ACCESSION NUMBER: NCBI ACCESSION: NZ_NJDE01000038.1
  ref <309>: DATABASE ENTRY DATE: 2019-04-01
  ref <313>: RELEVANT RESIDUES IN SEQ ID NO: (1)..(1393)
gctaataccggatacatcgtttcttcgcatgaagagacgaggaaagacggcgcaagctgtcactgagagatgggcctgcggcgcattagctagttggtggggtaatggctcaccaaggcgacgatgcgtagccgacctgagagggtgaacggccacactgggactgagacacggcccagactcctacgggaggcagcagtagggaatcttccacaatgggcgaaagcctgatggagcaatgccgcgtgagtgatgaaggttttcggatcgtaaagctctgttgccagggaagaacgtttcgtagagtaactgctacggaagtgacggtacctgagaagaaagccccggctaactacgtgccagcagccgcggtaatacgtagggggcaagcgttgtccggaattattgggcgtaaagcgcgtgcaggcggcttcttaagttgggtgtttaagaccggggctcaaccccggctcgcacccaaaactgggaagcttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacaggattagataccctggtagtccacgccgtaaacgatgagtgctaggtgttcggggtttcgataccctgggtgccgaagttcacgcattaagcactccgcctggggagtacggccgcaaggctgaaactcaaaggaattgacggggacccgcacaagcagtggagtatgtggtttaattcgaagcaacgcgaagaaccttaccaggtcttgacatccctctgaccggtctagagatagactttcccttcggggcagaggagacaggtggtgcatggttgtcgtcagctcgtgtcgtgagatgttgggttaagtcccgcaacgagcgcaacccttgactttagttgccagcatttcggatgggcactctagagtgactgccggtgacaaaccggaggaaggcggggatgacgtcaaatcatcatgccccttatgacctgggctacacacgtactacaatggccggtacagagggtcgcgaagccgcgaggtggagccaatcccagaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtgaggtaaccgcaaggagccagccgccgaaggtggggtagatgattggggtgaagtcgtaacaaggtagccgtatcggaaggtgcggctggatcacctcctttctatggaga

SEQ ID NO: 8154 - DNA, 1492 bp, Saccharibacter floricola
  ref <308>: DATABASE ACCESSION NUMBER: NCBI ACCESSION: NZ_KB899360.1
  ref <309>: DATABASE ENTRY DATE: 2019-04-01
  ref <313>: RELEVANT RESIDUES IN SEQ ID NO: (1)..(1492)
attgaacatgagagtttgattctggctcagagcgaacgctggcggcatgcttaacacatgcaagtcgcacgaacctttcggggttagtggcggacgggtgagtaacgcgtaggaacctatccagaggtgggggataacaccgggaaactggtgctaataccgcatgatacctgagggttaaaggcttttgttgcctttggaggggcctgcgtttgattagctagttggttgggtaaaggctgaccaaggcgatgatcaatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcactagggaagatgatgacggtacctagagaagaagccccggctaacttcgtgccagcagccgcggtaatacgaagggggctagcgttgctcggaatgactgggcgtaaagggcgcgtaggcggtttatacagtcagatgtgaaatccccgggcttaacctgggaactgcatttgatacgtatagactagagtccgagagaggattgcggaattcccagtgtagaggtgaaattcgtagatattgggaagaacaccagttgcgaaggcggcaatctggctcggaactgacgctgaggcgcgaaagcgtggggagcgaacaggattagataccctggtagtccacgctgtaaacgatgtgtgctggatgttgggaaacttagtttttcagtgtcgaagctaacgtgttaagcacaccgcctggggagtacgaccgcaaggttgaaactcaaagaaattgacgggggcccgcacaagcggtggagcatgtggtttaattcgaagcaacgcgcagaaccttaccaggtcttgtatggggaggacgtgctcagagatgagtatttcttcggacctcccgcacaggtgctgcatggctgtcgtcagctcgtgtcgtgagatgttgggttaagtcccgcaacgagcgcaacccctgtctttagttgccatcacgtttgggtgggcactctagagagactgccggtgacaagccggaggaaggtggggatgacgtcaagtcctcatggcccttatgacctgggctacacacgtgctacaatggcggtgacaatgggaagctacatggtgacatgatgccgatctcaaaaaaccgtctcagttcggattgcactctgcaactcgagtgcatgaaggtggaatcgctagtaatcgtggatcagcatgccacggtgaatacgttcccgggccttgtacacaccgcccgtcacaccatgggagttggtttgaccttaagccggtgagcgaaccgcaagggcgcagccgaccacggtcgggtcagcgactggggtgaagtcgtaacaaggtagccgtaggggaacctgcggctggatcacctcctttcaagg

SEQ ID NO: 8155 - DNA, 1490 bp, Saccharibacter sp. 3.A.1
  ref <308>: DATABASE ACCESSION NUMBER: NCBI ACCESSION: NZ_MNPT01000012.1
  ref <309>: DATABASE ENTRY DATE: 2019-04-01
  ref <313>: RELEVANT RESIDUES IN SEQ ID NO: (1)..(1490)
tgaacctgagagtttgatcctggctcagagcgaacgctggcggcatgcttaacacatgcaagtcgcacgaacctttcggggttagtggcggacgggtgagtaacgcgtaggaacctatctggaggtgggggataacatcgggaaactggtgctaataccgcatgatgcctgagggccaaaggagagatccgccattggaggggcctgcgttcgattagctagttggttgggtaaaggctgaccaaggcgatgatcgatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcactagggaagatgatgacggtacctagagaagaagccccggctaacttcgtgccagcagccgcggtaatacgaagggggctagcgttgctcggaatgactgggcgtaaagggcgcgtaggctgtytgtacagtcagatgtgaaatccccgggcttaacctgggaactgcatttgatacgtgcagactagagtccgagagagggttgtggaattcccagtgtagaggtgaaattcgtagatattgggaagaacaccggttgcgaaggcggcaacctggctcggaactgacgctgaggcgcgaaagcgtggggagcgaacaggattagataccctggtagtccacgctgtaaacgatgtgtgctggatgttgggtgattttatcattcagtgtcggagctaacgcgttaagcacaccgcctggggagtacggccgcaaggttgaaactcaaaggaattgacgggggcccgcacaagcggtggagcatgtggtttaattcgaagcaacgcgcagaaccttaccagggcttgcatggggaggctgtattcagagatggatatttcttcggacctcccgcacaggtgctgcatggctgtcgtcagctcgtgtcgtgagatgttgggttaagtcccgcaacgagcgcaacccttgtctttagttgccatcacgtctgggtgggcactctagagagactgccggtgacaagccggaggaaggtggggatgacgtcaagtcctcatggcccttatgtcctgggctacacacgtgctacaatggcggtgacagagggatgctacatggtgacatggtgctgatctcaaaaaaccgtctcagttcggattgtactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaagg

SEQ ID NO: 8156 - DNA, 1490 bp, Saccharibacter sp. AM169; identical to SEQ ID NO: 6546
  ref <308>: DATABASE ACCESSION NUMBER: NCBI ACCESSION: NZ_CBLY010000002.1
  ref <309>: DATABASE ENTRY DATE: 2019-04-01
  ref <313>: RELEVANT RESIDUES IN SEQ ID NO: (1)..(1490)

SEQ ID NO: 8157 - DNA, 1490 bp, Saccharibacter sp. M18
  ref <308>: DATABASE ACCESSION NUMBER: NCBI ACCESSION: NZ_MNPS01000010.1
  ref <309>: DATABASE ENTRY DATE: 2019-04-01
  ref <313>: RELEVANT RESIDUES IN SEQ ID NO: (1)..(1490)
tgaacctgagagtttgatcctggctcagagcgaacgctggcggcatgcttaacacatgcaagtcgcacgaacctttcggggttagtggcggacgggtgagtaacgcgtaggaacctatctggaggtgggggataacatcgggaaactggtgctaataccgcatgatgcctgagggccaaaggagagatccgccattggaggggcctgcgttcgattagctagttggttgggtaaaggctgaccaaggcgatgatcgatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcactagggaagatgatgacggtacctagagaagaagccccggctaacttcgtgccagcagccgcggtaatacgaagggggctagcgttgctcggaatgactgggcgtaaagggcgcgtaggctgtctgtacagtcagatgtgaaatccccgggcttaacctgggaactgcatttgatacgtgcagactagagtccgagagagggttgtggaattcccagtgtagaggtgaaattcgtagatattgggaagaacaccggttgcgaaggcggcaacctggctcggaactgacgctgaggcgcgaaagcgtggggagcgaacaggattagataccctggtagtccacgctgtaaacgatgtgtgctggatgttgggtgattttatcattcagtgtcggagctaacgcgttaagcacaccgcctggggagtacggccgcaaggttgaaactcaaaggaattgacgggggcccgcacaagcggtggagcatgtggtttaattcgaagcaacgcgcagaaccttaccagggcttgcatggggaggctgtagacagagatgtctatttcttcggacctcccgcacaggtgctgcatggctgtcgtcagctcgtgtcgtgagatgttgggttaagtcccgcaacgagcgcaacccttgtctttagttgccatcacgtctgggtgggcactctagagagactgccggtgacaagccggaggaaggtggggatgacgtcaagtcctcatggcccttatgtcctgggctacacacgtgctacaatggcggtgacagagggatgctacatggtgacatggtgctgatctcaaaaaaccgtctcagttcggattgtactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaagg

SEQ ID NO: 8158 - DNA, 1440 bp, Saccharopolyspora sp. H219
  ref <308>: DATABASE ACCESSION NUMBER: NCBI ACCESSION: NZ_RSAA01000012.1
  ref <309>: DATABASE ENTRY DATE: 2019-04-01
  ref <313>: RELEVANT RESIDUES IN SEQ ID NO: (1)..(1440)
ttgttggagagtttgatcctggctcaggacgaacgctggcggcgtgcttaacacatgcaagtcgaacgatgaagccgcttcggtggtggattagtggcgaacgggtgagtaacacgtgggtaatctgccctgcactctgggataagccttggaaacgaggtctaataccggatatgacacgtcaccgcatggtgtgcgtgtggaaagttccggcggtgcaggatgagcccgcggcctatcagcttgttggtggggtagtggcctaccaaggcgacgacgggtagccggcctgagagggtgaccggccacactgggactgagacacggcccagactcctacgggaggcagcagtggggaatcttgcgcaatgggcgaaagcctgacgcagcaacgccgcgtgggggatgacggccttcgggttgtaaacctctttcgacagggacgaagctttcgggtgacggtacctgtagaagaagcaccggctaactacgtgccagcagccgcggtaatacgtagggtgcgagcgttgtccggatttattgggcgtaaagagctcgtaggcggtttgtcgcgtcggccgtgaaaacctgcagcttaactgtgggcgtgcggtcgatacgggcagacttgagttcggcaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgccgtaaacgttgggcgctaggtgtggggaccggttccacggtttccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatgcaccagacagcctcagagatggggtttcccttgtggttggtgtacaggtggtgcatggctgtcgtcagctcgtgtcgtgagatgttgggttaagtcccgcaacgagcgcaacccttaccctatgttgccagcgggtgatgccggggactcgtgggggactgccggggtcaactcggaggaaggtggggatgacgtcaagtcatcatgccccttatgcccagggcttcacacatgctacaatggccggtacagagggtagcgataccgtgaggtggagcgaatcccttaaagctggtctcagttcggatcggggtctgcaactcgaccccgtgaagtcggagtcgctagtaatcgcagatcagcattgctgcggtgaatacgttcccgggccttgtacacaccgcccgtcacgtcatgaaagtcggtaacacccgaagcccatggcctaaccctgtggggggg

SEQ ID NO: 8159 - DNA, 1532 bp, Saccharospirillum mangrovi
  ref <308>: DATABASE ACCESSION NUMBER: NCBI ACCESSION: NZ_CP031415.1
  ref <309>: DATABASE ENTRY DATE: 2019-04-01
  ref <313>: RELEVANT RESIDUES IN SEQ ID NO: (1)..(1532)
aaactgaagagtttgatcatggctcagattgaacgctggcggcaggcctaacacatgcaagtcgagcggtaacaggactagcttgctagttgctgacgagcggcggacgggtgagtaacgcgtaggaatctgcccggtagttggggatagcccggagaaatccggattaataccgaataatctctgaggaggaaagggggcttcggctctcgctactggatgagcctgcgtgagattagctagttggtggggtaaaggctcaccaaggcgacgatctctagctggtctgagaggatgatcagccacactgggactgagacacggcccagactcctacgggaggcagcagtggggaatattggacaatgggggcaaccctgatccagccatgccgcgtgtgtgaagaaggctttcgggttgtaaagcactttcagacaggaggaagggttgatggttaatacccatcgacattgacgttactgtcagaagaagcaccggctaactccgtgccagcagccgcggtaatacggagggtgcgagcgttaatcggaataactgggcgtaaagcgcgcgtaggcggcaagttaagttgggtgtgaaagccccgggctcaacctgggaactgcattcaaaactggctcgcttgagtacggcagaggagtgtggaatttccggtgtagcggtgaaatgcgtagagatcggaaggaacaccagtggcgaaggcgacactctgggctgatactgacgctgaggtgcgaaagcgtggggagcaaacaggattagataccctggtagtccacgccgtaaacgatgtcgactagccgttgggacctttaaggacttggtggcgaagttaacgcgataagtcgaccgcctggggagtacggccgcaaggttaaaactcaaatgaattgacgggggcccgcacaagcggtggagcatgtggtttaattcgaagcaacgcgaagaaccttacctactcttgaaatccagagaacttagcagagatgctttggtgccttcgggaactctgagacaggtgctgcatggctgtcgtcagctcgtgttgtgaaatgttgggttaagtcccgtaacgagcgcaacccttatccttatttgccagcggttcggccggggactataaggagactgccggtgacaaaccggaggaaggcggggacgacgtcaagtcatcatggcccttacgagtagggctacacacgtgctacaatggccggtacagacggttgcgaagccgcgaggtggagctaatctgagaaagccggtcgtagtccggattggagtctgcaactcgactccatgaagtcggaatcgctagtaatcgtgaatcagaatgtcacggtgaatacgttcccgggccttgtacacaccgcccgtcacaccatgggagttgattgcaccagaagtgggtagcttaacattgggcgctcaccacggtgtggttgatgactggggtgaagtcgtaacaaggtaaccctaggggaacctggggttggatcacctccttaaac

SEQ ID NO: 8160 - DNA, 1533 bp, Saccharospirillum sp. LZ-5
  ref <308>: DATABASE ACCESSION NUMBER: NCBI ACCESSION: NZ_RCIP01000011.1
  ref <309>: DATABASE ENTRY DATE: 2019-04-01
  ref <313>: RELEVANT RESIDUES IN SEQ ID NO: (1)..(1533)
aaactgaagagtttgatcatggctcagattgaacgctggcggcaggcctaacacatgcaagtcgagcggtaacaggggtagcttgctacccgctgacgagcggcggacgggtgagtaacgcgtaggaatctacccggtagttggggatagcccggagaaatccggattaataccgaataatctctacggaggaaagggggcttcggctctcgctactggatgagcctgcgtcggattagctagttggtggggtaaaggcttaccaaggcgacgatccgtagctggtctgagaggatgatcagccacactgggactgagacacggcccagactcctacgggaggcagcagtggggaatattggacaatgggggcaaccctgatccagccatgccgcgtgtgtgaagaaggccttcgggttgtaaagcactttcagtgaggaggaaggggtgatggttaatacccatcatcattgacgttactcacagaagaagcaccggctaactccgtgccagcagccgcggtaatacggagggtgcaagcgttaatcggaattactgggcgtaaagcgcgcgtaggcggcaagttaagttgggtgtgaaagccccgggctcaacctgggaactgcattcaaaactggctagctagagtacagcagaggatagtggaatttccggtgtagcggtgaaatgcgtagagatcggaaggaacaccagtggcgaaggcgactgtctgggctgatactgacgctgaggtgcgaaagcgtggggagcaaacaggattagataccctggtagtccacgccgtaaacgatgtcgactaaccgttgggttctttatggacttggtggtgaagttaacgcgataagtcgaccgcctggggagtacggccgcaaggttaaaactcaaatgaattgacgggggcccgcacaagcggtggagcatgtggtttaattcgaagcaacgcgaagaaccttacctactcttgaaatccagtgaacttagcagagatgctttggtgccttcgggaacactgagacaggtgctgcatggctgtcgtcagctcgtgttgtgaaatgttgggttaagtcccgtaacgagcgcaacccctatccttatttgccagcgagtaatgtcggggactataaggagactgccggtgacaaaccggaggaaggcggggatgacgtcaagtcatcatggcccttacgagtagggctacacacgtgctacaatggccggtacagacggttgcgaagccgcgaggtggagctaatctgagaaagccggtcgtagtccggattggagtctgcaactcgactccatgaagtcggaatcgctagtaatcgtgaatcagaatgtcacggtgaatacgttcccgggccttgtacacaccgcccgtcacaccatgggagttgattgcaccagaagtcggtagcttaaaattgggcgctgaccacggtgtggttaatgactggggtgaagtcgtaacaaggtaaccctaggggaacctggggttggatcacctccttaaac

SEQ ID NO: 8161 - DNA, 1525 bp, Saccharothrix australiensis
  ref <308>: DATABASE ACCESSION NUMBER: NCBI ACCESSION: NZ_RBXO01000001.1
  ref <309>: DATABASE ENTRY DATE: 2019-04-01
  ref <313>: RELEVANT RESIDUES IN SEQ ID NO: (1)..(1525)
cttattggagagtttgatcctggctcaggacgaacgctggcggcgtgcttaacacatgcaagtcgagcggtaaggcccttcggggtacacgagcggcgaacgggtgagtaacacgtgggtaacctgccctgtactccgggataagcctgggaaactaggtctaataccggatacgaccttccatcgcatggtggggggtggaaagttccggcggtatgggatggacccgcggcctatcagcttgttggtggggtgatggcctaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgtgagtgacggtacctgcagaagaagcaccggctaactacgtgccagcagccgcggtaatacgtagggtgcgagcgttgtccggaattattgggcgtaaagagctcgtaggcggtttgttgcgtcggccgtgaaaacttcacgcttaacgtggagcctgcggtcgatacgggcagacttgagttcggcaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgccgtaaacggtgggtgctaggtgtggggggcttccacgtcctccgtgccgcagctaacgcattaagcaccccgcctggggagtacggccgcaaggctaaaactcaaaggaattgacgggggcccgcacaagcggcggagcatgtggattaattcgatgcaacgcgaagaaccttacctgggcttgacatgcaccggaaacctccagagatgggggcctcttcggactggtgtacaggtggtgcatggctgtcgtcagctcgtgtcgtgagatgttgggttaagtcccgcaacgagcgcaaccctcgttccatgttgccagcgcgtgatggcggggactcatgggagactgccggggtcaactcggaggaaggtggggatgacgtcaagtcatcatgccccttatgtccagggcttcacacatgctacaatggccggtacagagggctgctaagccgtgaggtggagcgaatcccagaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggtaacacccgaagcccgtggcccaacccgtatgggggggagcggtcgaaggtgggactggcgattgggacgaagtcgtaacaaggtagccgtaccggaaggtgcggctggatcacctcctttctaaggag

SEQ ID NO: 8162 - DNA, 1527 bp, Saccharothrix texasensis
  ref <308>: DATABASE ACCESSION NUMBER: NCBI ACCESSION: NZ_RJKM01000001.1
  ref <309>: DATABASE ENTRY DATE: 2019-04-01
  ref <313>: RELEVANT RESIDUES IN SEQ ID NO: (1)..(1527)
cttattggagagtttgatcctggctcaggacgaacgctggcggcgtgcttaacacatgcaagtcgagcggtaaggcccttcggggtacacgagcggcgaacgggtgagtaacacgtgggtaacctgccctgtactctgggataagcctgggaaactaggtctaataccggatatgactccattaggcatcttgtggggtggaaagttccggcggtacaggatggacccgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcggggacgaagggcaactgacggtacccgcagaagaagcaccggctaactacgtgccagcagccgcggtaatacgtagggtgcgagcgttgtccggaattattgggcgtaaagagctcgtaggcggtttgttgcgtcggctgtgaaaacttcacgcttaacgtggagcctgcagtcgatacgggcagacttgagttcggcaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgccgtaaacggtgggtgctaggtgtgggggacttccacgtcctccgtgccgcagctaacgcattaagcaccccgcctggggagtacggccgcaaggctaaaactcaaaggaattgacgggggcccgcacaagcggcggagcatgtggattaattcgatgcaacgcgaagaaccttacctgggcttgacatgcaccggaaacctgcagagatgtaggcctcttcggactggtgtacaggtggtgcatggctgtcgtcagctcgtgtcgtgagatgttgggttaagtcccgcaacgagcgcaaccctcgttccatgttgccagcgcgtaatggcggggactcatgggagactgccggggtcaactcggaggaaggtggggatgacgtcaagtcatcatgccccttatgtccagggcttcacacatgctacaatggccggtacagagggctgctaagccgtgaggtggagcgaatcccacaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggtaacacccgaagcccgtggcccaaccagcttgctggggggagcggtcgaaggtgggactggcgattgggacgaagtcgtaacaaggtagccgtaccggaaggtgcggctggatcacctcctttctaaggag

SEQ ID NO: 8163 - DNA, 1525 bp, Saccharothrix variisporea
  ref <308>: DATABASE ACCESSION NUMBER: NCBI ACCESSION: NZ_RBXR01000001.1
  ref <309>: DATABASE ENTRY DATE: 2019-04-01
  ref <313>: RELEVANT RESIDUES IN SEQ ID NO: (1)..(1525)
cttattggagagtttgatcctggctcaggacgaacgctggcggcgtgcttaacacatgcaagtcgagcggtaaggcccttcggggtacacgagcggcgaacgggtgagtaacacgtgggtaacctgccctgtactctgggataagcctgggaaactaggtctaataccggatacgaccacttcgggcatccgttgtggtggaaagttccggcggtatgggatggacccgcggcctatcagcttgttggtggggtgatggcctaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcgagtgacggtacctgcagaagaagcaccggctaactacgtgccagcagccgcggtaatacgtagggtgcgagcgttgtccggaattattgggcgtaaagagctcgtaggcggtttgttgcgtcggccgtgaaaacttcacgcttaacgtggagcctgcggtcgatacgggcagacttgagttcggcaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgccgtaaacggtgggtgctaggtgtggggggcttccacgtcctccgtgccgcagctaacgcattaagcaccccgcctggggagtacggccgcaaggctaaaactcaaaggaattgacgggggcccgcacaagcggcggagcatgtggattaattcgatgcaacgcgaagaaccttacctgggcttgacatgcaccggaaacctgcagagatgtaggcctcttcggactggtgtacaggtggtgcatggctgtcgtcagctcgtgtcgtgagatgttgggttaagtcccgcaacgagcgcaaccctcgttccatgttgccagcgcgttatggcggggactcatgggagactgccggggtcaactcggaggaaggtggggatgacgtcaagtcatcatgccccttatgtccagggcttcacacatgctacaatggccggtacagagggctgctaagccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggtaacacccgaagcccgtggcccaacccgtatgggggggagcggtcgaaggtgggactggcgattgggacgaagtcgtaacaaggtagccgtaccggaaggtgcggctggatcacctcctttctaaggag

SEQ ID NO: 8164 - DNA, 1454 bp, Sagittula sp. P11
  ref <308>: DATABASE ACCESSION NUMBER: NCBI ACCESSION: NZ_CP021913.1
  ref <309>: DATABASE ENTRY DATE: 2019-04-01
  ref <313>: RELEVANT RESIDUES IN SEQ ID NO: (1)..(1454)
tcaacttgagagtttgatcctggctcagaacgaacgctggcggcaggcctaacacatgcaagtcgtgcgcgccttcgggtgagcggcggacgggtgagtaacacgtgggaatgtgcccttctgttgaggatagccccgggaaactgggagtaatactcgatacgcccttagggggaaggaaggatcagcccgcgtctgattaggtagttggtggggtaatggcctaccaagcctacgatcagtagctggttttagaggatgatcagccacactgggactgagacacggcccagactcctacgggaggcagcagtgaggaatcttagacaatgggcgcaagcctgatctagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggactggaaagttgggggtgaaatcccagggctcaaccctggaactgcctccaaaactatcagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctaacccgagagatcgggctttcccttcggggacgcagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatccccaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacctgacggccgtgcgctaaccttcgggaggcagcggaccacggtaggatcagcgactggggtgaagtcgtaacaaggtagccgtaggggaacctgcggctggatcacctcctttctaa

SEQ ID NO: 8165 - DNA, 1454 bp, Sagittula stellata
  ref <308>: DATABASE ACCESSION NUMBER: NCBI ACCESSION: NZ_AAYA01000003.1
  ref <309>: DATABASE ENTRY DATE: 2019-04-01
  ref <313>: RELEVANT RESIDUES IN SEQ ID NO: (1)..(1454)
tcaacttgagagtttgatcctggctcagaacgaacgctggcggcaggcctaacacatgcaagtcgtgcgcgccttcgggtgagcggcggacgggtgagtaacacgtgggaatatgcccttctgttgaggatagccccgggaaactgggagtaatactcgatacgccctttgggggaaggaaggattagcccgcgtctgattaggtagttggtggggtaatggcctaccaagcctacgatcagtagctggttttagaggatgatcagccacactgggactgagacacggcccagactcctacgggaggcagcagtgaggaatcttagacaatgggcgcaagcctgatctagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggactggaaagttgggggtgaaatcccagggctcaaccctggaactgcctccaaaactatcagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctaacccgagagatcgggctttcccttcggggacgcagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatccccaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacctgacggccgtgcgctaaccttcgggaggcagcggaccacggtaggatcagcgactggggtgaagtcgtaacaaggtagccgtaggggaacctgcggctggatcacctcctttctaa

SEQ ID NO: 8166 - DNA, 1532 bp, Salana multivorans
  ref <308>: DATABASE ACCESSION NUMBER: NCBI ACCESSION: NZ_RKHQ01000001.1
  ref <309>: DATABASE ENTRY DATE: 2019-04-01
  ref <313>: RELEVANT RESIDUES IN SEQ ID NO: (1)..(1532)
ttgacggagagtttgatcctggctcaggacgaacgctggcggcgtgctttacacatgcaagtcgaacggactggctcagcttgctgggttggttagtggcgaacgggtgagtaacacgtgagtaacctgccccagactctgggataactaccggaaacggtggctaatactggatatgacacattatcgcatggtggtgtgtggaaaggcttgtctggtttgggatggactcgcggcctatcagcttgttggtggggtagtggcctaccaaggctttgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcctttgggtgacggtacctgcagaagaagcgccggctaactacgtgccagcagccgcggtaatacgtagggcgcgagcgttgtccggaattattgggcgtaaagagctcgtaggcggtttgtcgcgtctgctgtgaaatcctcaggctcaacttgaggcgtgcagtgggtacgggcagactagagtgcggtaggggagactggaattcctggtgtagcggtggaatgcgcagatatcaggaggaacaccgatggcgaaggcaggtctctgggccgttactgacgctgaggagcgaaagcatggggagcgaacaggattagataccctggtagtccatgccgtaaacgttgggcactaggtgtggggtccattccacgggttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaagctttgacatgcacgggaagccaccagagatggtggtctctttggacactcgtgcacaggtggtgcatggttgtcgtcagctcgtgtcgtgagatgttgggttaagtcccgcaacgagcgcaaccctcgtcccatgttgccagcacgtagtggtggggactcatgggagactgccggggtcaactcggaggaaggtggggatgacgtcaaatcatcatgccccttatggcttgggcttcacgcatgctacaatggccggtacaaagggctgcgataccgtaaggtggagcgaatcccataaagccggtctcagttcggattggggtctgcaactcgaccccatgaagtcggagtcgctagtaatcgcagatcagcaatgctgcggtgaatacgttctcgggccttgtacacaccgcccgtcaagtcatgaaagtcggtaacacccgaagccagtggcccaacccttgtggggggagctgtcgaaggtgggattggcgattaggactaagtcgtaacaaggtagccgtaccggaaggtgcggctggatcacctcctttctaagga

SEQ ID NO: 8167 - DNA, 1482 bp, Salibacterium halotolerans
  ref <308>: DATABASE ACCESSION NUMBER: NCBI ACCESSION: NZ_FOXD01000044.1
  ref <309>: DATABASE ENTRY DATE: 2019-04-01
  ref <313>: RELEVANT RESIDUES IN SEQ ID NO: (1)..(1482)
cggggtgaaacctgtggaacgagcggcggacgggtgagtaacacgtgggcaacctgcctgaaagtccgggataaccccgggaaaccggagctaataccggatgagcctgtcgaccgcctggtcgacggggaaaagcggggattttcctcgcgctttcagatgggcccgcggcgcattagcttgttggagaggtaaaagctccccaaggcaacgatgcgtagccgacctgagagggtgatcggccacactgggactgagacacggcccagactcctacgggaggcagcagtagggaatcatccgcaatgggcgaaagcctgacggtgcaacgccgcgtgagtgaagaaggttttcggatcgtaaagctctgttatccgagaagaacaaggactggtcaaacaggccggttccatgacggtaccggatcagaaagccccggctaactacgtgccagcagccgcggtaatacgtagggggcaagcgttgtccggaattattgggcgtaaagggcgcgcaggcggtttcctaagtctgatgtgaaaggccacggctcaaccgtggaatggcattggaaactggggaacttgagtacaggagaggaaagcggaattccacgtgtagcggtgaaatgcgtagagatgtggaggaacaccagtggcgaaggcggctttctggcctgtaactgacgctgaggcgcgaaagcgtggggagcgaacaggattagataccctggtagtccacgccgtaaacgttgagtgctaggtgttaggggtttcgacgcccttagtgccgaagcaaacgcattaagcactccgcctggggagtacgaccgcaaggttgaaactcaaaggaattgacgggggcccgcacaagcggtggagcatgtggtttaattcgacgcaacgcgaagaaccttaccaggtcttgacatcttctgaccgctccagagatggagttttccccttcgggggacagaatgacaggtggtgcatggttgtcgtcagctcgtgtcgtgagatgttgggttaagtcccgcaacgagcgcaacccttaaccttagttgccagcattaagttgggcactctagggtgactgccggtgacaaaccggaggaaggcggggatgacgtcaaatcatcatgccccttatgacctgggctacacacgtgctacaatggatggtacagagggcagcgaagccgcgaggtggagcgaatcccaaaaagccattctcagttcggactgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtggggtaaccttttcaggagccagccgccgaaggtggggcaggtgattggggtgaagtcgtaacaaggtatccctaccggaaggtggggatggatcacctcctttcta

SEQ ID NO: 8168 - DNA, 253 bp, Salibacterium qingdaonense
  ref <308>: DATABASE ACCESSION NUMBER: NCBI ACCESSION: NZ_FOTY01000012.1
  ref <309>: DATABASE ENTRY DATE: 2019-04-01
  ref <313>: RELEVANT RESIDUES IN SEQ ID NO: (1)..(253)
ttaatggagagtttgatcctggctcaggacgaacgctggcggcgtgcctaatacatgcaagtcgagcgcgggaagcggacggaaatcctccggggtggaaatccgtggaacgagcggcggacgggtgagtaacacgtgggcaacctgcctgaaagtccgggataaccccgggaaaccggggctaataccggatgggcctgtcgaccgcctggtcgacggggaaaagtggggatcttcctcacgctttcagatg

SEQ ID NO: 8169 - DNA, 1077 bp, Salimicrobium album
  ref <308>: DATABASE ACCESSION NUMBER: NCBI ACCESSION: NZ_FNOS01000012.1
  ref <309>: DATABASE ENTRY DATE: 2019-04-01
  ref <313>: RELEVANT RESIDUES IN SEQ ID NO: (1)..(1077)
cggtcccttgacggtacctcacgaggaagccccggctaactacgtgccagcagccgcggtaatacgtagggggcaagcgttgtccggaattattgggcgtaaagggcacgcaggcggttccttaagtctgatgtgaaagcccgtggctcaaccacggatggccattggaaactggggaacttgagaactgaagaggagagtggaattccacgtgtagcggtgaaatgcgtagatatgtggaggaacaccagtggcgaaggcgactctctggtcggtttctgacgctgaggtgcgaaagcgtgggtagcaaacaggattagataccctggtagtccacgccgtaaacgctgagtgctaggtgttagggggcttccaccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttggctacttccagagatggaaggttcccttcggggaccaagtgacaggtggtgcatggttgtcgtcagctcgtgtcgtgagatgttgggttaagtcccgcaacgagcgcaacccctaatcttagttgccagcattcagttgggcactctaaggtgactgccggtgacaaaccggaggaaggcggggatgacgtcaaatcatcatgccccttatgacctgggctacacacgtgctacaatggatgggacaaacggaagcgaacccgcgaggggtagccaatccgagaaacccattctcagttcggattgcaggctgcaactcgcctgcatgaagccggaatcgctagtaatcgcagatcagcatgctgcggtgaatacgttcccgggccttgtacacaccgcccgtcacaccacgagagttggcaacacccgaagccggtgaggtaacctttacaggagccagccgtcgaaggtggggccaatgattggggtgaagtcgtaacaaggtagccgtatcggaaggtgcggctggatcacctcctttctaa

SEQ ID NO: 8170 - DNA, 1574 bp, Salimicrobium flavidum
  ref <308>: DATABASE ACCESSION NUMBER: NCBI ACCESSION: NZ_FTOC01000024.1
  ref <309>: DATABASE ENTRY DATE: 2019-04-01
  ref <313>: RELEVANT RESIDUES IN SEQ ID NO: (1)..(1574)
ttttatggagagtttgatcctggctcaggacgaacgctggcggcgtgcctaatacatgcaagtcgagcgcgggaagcgaccggaagcccttcggggtggaaggtcgtggaacgagcggcggacgggtgagtaacacgtgggcaacctacctgtaagaccggaataaccccgggaaaccggggctaatgccgggtaatcgatcggttcacctgaaccgattgtaaaaggatggcttcttgctatcgcttacagatgggcccgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgaatgatgaaggtcttcggatcgtaaaattctgttgtgagggaagaacaaggaccgtgcgaacagaacggtcccttgacggtacctcacgaggaagccccggctaactacgtgccagcagccgcggtaatacgtagggggcaagcgttgtccggaattattgggcgtaaagggcacgcaggcggttccttaagtctgatgtgaaagcccgtggctcaaccacggatggccattggaaactggggaacttgagaactgaagaggagagtggaattccacgtgtagcggtgaaatgcgtagatatgtggaggaacaccagtggcgaaggcgactctctggtcggtttctgacgctgaggtgcgaaagcgtgggtagcaaacaggattagataccctggtagtccacgccgtaaacgctgagtgctaggtgttagggggcttccaccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttggacacttccagagatggaaggttcccttcggggaccaagtgacaggtggtgcatggttgtcgtcagctcgtgtcgtgagatgttgggttaagtcccgcaacgagcgcaacccctaatcttagttgccagcattcagttgggcactctaaggtgactgccggtgacaaaccggaggaaggcggggacgacgtcaaatcatcatgccccttatgacctgggctacacacgtgctacaatggatgggacaaacggatgcgaacccgcgaggggtagccaatccgagaaacccattctcagttcggattgcaggctgcaactcgcctgcatgaagccggaatcgctagtaatcgcagatcagcatgctgcggtgaatacgttcccgggccttgtacacaccgcccgtcacaccacgagagttggcaacacccgaagccggtgaggtaacctttacaggagccagccgtcgaaggtggggccaatgattggggtgaagtcgtaacaaggtagccgtatcggaaggtgcggctggatcacctcctttctaa

SEQ ID NO: 8171 - DNA, 319 bp, Salimicrobium halophilum
  ref <308>: DATABASE ACCESSION NUMBER: NCBI ACCESSION: NZ_FNEV01000011.1
  ref <309>: DATABASE ENTRY DATE: 2019-04-01
  ref <313>: RELEVANT RESIDUES IN SEQ ID NO: (1)..(319)
ttatggagagtttgatcctggctcaggacgaacgctggcggcgtgcctaatacatgcaagtcgagcgcgggaagcgagctgaagcccttcggggcggacgctcgtggaacgagcggcggacgggtgagtaacacgtgggcaacctacctgtaagaccggaataaccccgggaaaccggggctaatgccgggtaaccgttcggttctcctgaaccgaacgtaaaaggatggcttcttgctatcgcttacagatgggcccgcggcgcattagctagttggtaaggtaacggcttaccaaggcgacgatgcgtagccgacct

SEQ ID NO: 8172 - DNA, 1573 bp, Salimicrobium salexigens
  ref <308>: DATABASE ACCESSION NUMBER: NCBI ACCESSION: NZ_FTOK01000022.1
  ref <309>: DATABASE ENTRY DATE: 2019-04-01
  ref <313>: RELEVANT RESIDUES IN SEQ ID NO: (1)..(1573)
tttatggagagtttgatcctggctcaggacgaacgctggcggcgtgcctaatacatgcaagtcgagcgcgggaagcgagcagaagcccttcggggcggacgctcgtggaacgagcggcggacgggtgagtaacacgtgggcaacctgcctgtaagaccggaataaccccgggaaaccggggctaatgccggataacccaacggttctcctgaaccgatggtaaaaggatggcttcttgctatcgcttacagatgggcccgcggcgcattagctggttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaatgatgaaggtcttcggatcgtaaaattctgttgtgagggaagaacaaggatcgtgcgaacagaacggtcccttgacggtacctcacgaggaagccccggctaactacgtgccagcagccgcggtaatacgtagggggcaagcgttgtccggaattattgggcgtaaagggcacgcaggcggttccttaagtctgatgtgaaagcccgtggctcaaccacggatggccattggaaactggggaacttgagaactgaagaggagagtggaattccacgtgtagcggtgaaatgcgtagatatgtggaggaacaccagtggcgaaggcgactctctggtcggtttctgacgctgaggtgcgaaagcgtgggtagcaaacaggattagataccctggtagtccacgccgtaaacgctgagtgctaggtgttagggggcttccaccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttggctacttccagagatggaaggttcccttcggggaccaagtgacaggtggtgcatggttgtcgtcagctcgtgtcgtgagatgttgggttaagtcccgcaacgagcgcaacccctaatcttagttgccagcattcagttgggcactctaaggtgactgccggtgacaaaccggaggaaggcggggatgacgtcaaatcatcatgccccttatgacctgggctacacacgtgctacaatggatgggacaaacggaagcgaacccgcgaggggtagccaatccgagaaacccattctcagttcggattgcaggctgcaactcgcctgcatgaagccggaatcgctagtaatcgcagatcagcatgctgcggtgaatacgttcccgggccttgtacacaccgcccgtcacaccacgagagttggcaacacccgaagccggtgaggtaacctttacaggagccagccgtcgaaggtggggccaatgattggggtgaagtcgtaacaaggtagccgtatcggaaggtgcggctggatcacctcctttctaa

SEQ ID NO: 8173 - DNA, 1575 bp, Salimicrobium sp. WN024
  ref <308>: DATABASE ACCESSION NUMBER: NCBI ACCESSION: NZ_NSGH01000046.1
  ref <309>: DATABASE ENTRY DATE: 2019-04-01
  ref <313>: RELEVANT RESIDUES IN SEQ ID NO: (1)..(1575)
tttatggagagtttgatcctggctcaggacgaacgctgggggcgtgcctaatacatgcaactcgagcgcgggaagcgagctgaagcccttcgcggcggacgctcgtggaacgagcggcggacgcgtgagtaacacgtgggcaacctgcctgtaagaccggaataaccccgggaaaccggggctaatgccggataatcaatcggttctcctgaaccgatggtaaaaggatggccttagcggctatcgcttacagatgggcccgcggcgcattagctggttggtgaggtaacggctcaccaaggcgacgatgcgtagccgacctgagagggtgatcggccacactgggactgagacacggcccagactcctacgggaggcagcagtagggaatcttccgcaatggacgtaagtctgacggagcaacgccgcgtgaatgatgaaggtcttcggatcgtaaaaatctgttgtgagggaagaacaaggaccgtgcgaacagaacggacccttgacggtacctcacgaggaagcccccgctaactacgtgccagcagccgcggtaatacgtagggggcaagcgttgtccggaattattgggcgtaaagggcacgcaggcggttccttaagtctgatgtgaaagcccgtggctcaaccacggatggccattggaaactggggaacttgaggactgaagaggagagtggaattccacgtgtagcggtgaaatgcgtagatatgtggaggtacaccagtggcgaaggcgactctctggtcggtttctgacgctgaggtgcgatagcgtgggtagcaaacaggattagataccctggtagtccacgccgtaaacgctgagtgctaggtgttagggggcttccaccccttagtgctgaagttaacgcattaagcactccgcctggggagtacggccgcatggctgatactcaaaggaattgacgggggcccgcacaagcggaggagcatgtggtttaattcgaagcaacgcgaagaaccttaccagatcttgacatccttggctacttcgagagatggaaggttcccttcggggaccaagtgacaggtggtgcatggttgtcgtcagctcgtgtcgtgagatgttgggttaagtcccgcaacgagcgcaacccctaatcttagttgccagcattcagttgggcactctaaggtgactgccggtgacaaaccggaggaaggcggggatgacgtcaaatcatcatgccccttatgacctgggctacacacgtgctacaatggatgggacaaacggatgcgaacccgcgacgggtagccaatccgagaaagccattctcagttcggattgcaggctgcaactcgcctgcatgaagccggaatcgctagtaatcgcagttcagcatgctgcggtgaatacgttcccgggccatgtacacaccgcccgtcacaccacgagagttggcaacacccgaagccggtgaggtaaccttttcaggagccagccgtcgaaggtggcgccaatgattggggtgaactcgtaacaaggtaggcgtatcggaaggtgcggctggatcacctcctttctaa

SEQ ID NO: 8174 - DNA, 1499 bp, Salinarimonadaceae bacterium HL-109
  ref <308>: DATABASE ACCESSION NUMBER: NCBI ACCESSION: NZ_FMBM01000002.1
  ref <309>: DATABASE ENTRY DATE: 2019-04-01
  ref <313>: RELEVANT RESIDUES IN SEQ ID NO: (1)..(1499)
ctcttcaacttgagagtttgatcctggctcagagcgaacgctggcggcaggcctaacacatgcaagtcgaacgcagtcttcggactgagtggcagacgggtgagtaacgcgtgggaacgtgcccatcggttcgggataaccaagggaaactttggctaataccggatacgtgcgagagcagaaagatttatcgccgatggatcggcccgcgtctgattagcttgttggtggggtaatggctcaccaaggcgacgatcagtagctggtttgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaagaataagccccggctaacttcgtgccagcagccgcggtaatacgaagggggctagcgttgctcggaatcactgggcgtaaagggcgcgtaggcggacatttaagtcgggggtgaaagcccggggctcaaccccggaattgcctccgatactgggtgtctcgagaccggaagaggtaagtggaactgcgagtgtagaggtgaaattcgtagatattcgcaagaacaccagtggcgaaggcggcttactggtccggatctgacgctgaggcgcgaaagcgtggggagcaaacaggattagataccctggtagtccacgccgtaaacgatgaatgccagctgttggcgggcttgcccgtcagtggcgcagttaacgctttgagcattccgcctggggagtacggtcgcaagattaaaactcaaaggaattgacgggggcccgcacaagcggtggagcatgtggtttaattcgaagcaacgcgcagaaccttaccagctcttgacatgtctcgtttggggagtggagacacttctcttcagttcggctggcgggaacacaggtgctgcatggctgtcgtcagctcgtgtcgtgagatgttgggttaagtcccgcaacgagcgcaaccctcgcccttagttgccagcatttggttgggcactctagggggactgccggtgataagccgagaggaaggtggggatgacgtcaagtcctcatggcccttacgggctgggctacacacgtgctacaatggcggtgacaatgggcagcgaaggggcgacctggagctaatcccaaaaagccgtctcagttcggattgcactctgcaactcgggtgcatgaaggtggaatcgctagtaatcgtggatcagcatgccacggtgaatacgttcccgggccttgtacacaccgcccgtcacaccatgggagttggttctacccgacggcgctgcgctaacccgcgagggaggcaggcgaccacggtaggatcagcgactggggtgaagtcgtaacaaggtagccgtaggggaacctgcggctggatcacctcctttctaag

SEQ ID NO: 8175 - DNA, 1498 bp, Salinarimonas rosea
  ref <308>: DATABASE ACCESSION NUMBER: NCBI ACCESSION: NZ_AUBC01000058.1
  ref <309>: DATABASE ENTRY DATE: 2019-04-01
  ref <313>: RELEVANT RESIDUES IN SEQ ID NO: (1)..(1498)
catctcttcaacgtgagagtttgatcctggctcagagcgaacgctggcggcaggcttaacacatgcaagtcgaacgcaccttcgggtgagtggcagacgggtgagtaacgcgtgggaacgtgcccatcggttcggaataaccaagggaaactttggctaataccggatacgtgcgagagcagaaagatttatcgccgatggatcggcccgcgtccgattagctagttggtgaggtaacggctcaccaaggcgacgatcggtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgcacgcgacgataatgacggtagcgtgagaagaagccccggctaacttcgtgccagcagccgcggtaatacgaagggggctagcgttgctcggaatcactgggcgtaaagggcgcgtaggcggatctttaagtcgggggtgaaagcccagggctcaaccctggaattgcctccgatactggggatctagagaccggaagaggtgagtggaactgcgagtgtagaggtgaaattcgtagatattcgcaagaacaccagtggcgaaggcggctcactggtccggatctgacgctgaggcgcgaaagcgtggggagcaaacaggattagataccctggtagtccacgccgtaaacgatgaatgccagccgttggcgtgcttgcacgtcagtggcgcagctaacgctttgagcattccgcctggggagtacggccgcaaggttaaaactcaaaggaattgacgggggcccgcacaagcggtggagcatgtggtttaattcgaagcaacgcgcagaaccttaccagcctttgacatgtcccggacggttaccagagatggtttcttctcttcggagccgggaacacaggtgctgcatggctgtcgtcagctcgtgtcgtgagatgttgggttaagtcccgcaacgagcgcaaccctcgcccctagttgccatcattcagttgggcactctagggggactgccggcgataagccgagaggaaggtggggatgacgtcaagtcctcatggcccttacgggctgggctacacacgtgctacaatggcggtgacaatgggcagcgaaggggcgacctggagctaatccccaaaagccgtctcagttcggattgcactctgcaactcgagtgcatgaaggtggaatcgctagtaatcgtggatcagcatgccacggtgaatacgttcccgggccttgtacacaccgcccgtcacaccatgggagttggttctacccgacggcgctgcgccaaccgcaaggaggcaggcgaccacggtagggtcagcgactggggtgaagtcgtaacaaggtagccgtaggggaacctgcggctggatcacctcctttctaagga

SEQ ID NO: 8176 - DNA, 1541 bp, Salinibacter ruber
  ref <308>: DATABASE ACCESSION NUMBER: NCBI ACCESSION: NZ_CP030364.1
  ref <309>: DATABASE ENTRY DATE: 2019-04-01
  ref <313>: RELEVANT RESIDUES IN SEQ ID NO: (1)..(1541)
actacggagagtttgatcctagctcaggacgaacgctggcggcaggcttaacacatgcaagtcgcacgagaacgttctggctttgccaggacaagtacagtggcggacgggtgcgtatcgcgtagataacctgccctcaggcgcgggacaatcacgggaaaccgtggctaataccgcacgtcgtctggaccccgcatggggaccagatgaaagccttcgggcgcctttggatgggtctgcgttggattagcttgttggtgaggtaacggctcaccaaggcaacgatccatagctggtctgagaggacgatcagccacactgggactgagacacggcccagactcctacgggaggcagcagtggggaatcttgcacaatggggtcacccctgatgcagccatgccgcgtggaggaagacacccctatggggcgtaaactccttttctgaatgaagaaacccctgtagcttcagggcgcgacggtagttcaggaataagcaccggctaactccgtgccagcagccgcggtaatacggagggtgcaagcgttgtccggaatcactgggtgtaaagggtgtgcaggcggggcagcaagtcggatgtgaaaccccatggcttaaccatggaggtgcattcgaaactgttgctcttgagtcccggagaggctgtcggaattcgtggtgtagcggtgaaatgcgtagatatcacgaggaacaccagaggcgaaagcggacagctggacgggtactgacgctcaggcacgaaagcgtggggagcaaacaggattagataccctggtagtccacgccgtaaacgatgaatgctcgccgttgcctcgttagggggcagtggctaagctaacgcgttaagcattccacctggggagtacgatcgcaaggttgaaactcaaaggaattgacgggggcccgcacaagcggtggagcatgtggctcaattcgatgcaacgcgaagaaccttacctaggctcgaacgctaaaggaccgctcctgaaagggagcttcccctttggggcttttagcgaggtactgcatggctgtcgtcagctcgtgtcgtgagatgttgggttaagtcccgcaacgagcgtaacccctgttgctagttaccagcggataatgccggggactctagcgaaactgcctgcgcaagcagtgaggaaggtggggatgacgtcaagtcatcatggtccttacgcctagggctgcacacgtgctacaatggccggtacaacgagcagccacctcgcgagagggagcgaatctctgaaaaccggtcccagttcggattggagtctgcaactcgactccatgaagcaggaatcgctagtaatcgcggatcagcaatgccgcggtgaatccgttcccgggccttgtacacaccgcccgtcaagccatggaagctgagagcacccgaagtccgtgacccaaccttttgggagggagcggccgaaggtgagctcagtgactggggctaagtcgtaacaaggtagccgtaggggaacctgcggctggatcacctcctaaa

SEQ ID NO: 8177 - DNA, 1526 bp, Salinibacterium amurskyense
  ref <308>: DATABASE ACCESSION NUMBER: NCBI ACCESSION: NZ_RCWI01000003.1
  ref <309>: DATABASE ENTRY DATE: 2019-04-01
  ref <313>: RELEVANT RESIDUES IN SEQ ID NO: (1)..(1526)
tttatggagagtttgatcctggctcaggatgaacgctggcggcgtgcttaacacatgcaagtcgaacgatgaagccggagcttgctctggtggattagtggcgaacgggtgagtaacacgtgagtaacctgcccttgactctggaataagcgttggaaacgacgtctaataccggatacgagcttccgccgcatggtgaggagctggaaagaatttcggtcaaggatggactcgcggcctatcaggtagttggtgaggtaatggctcaccaagcctacgacgggtagccggcctgagagggtgaccggccacactggaactgagacacggtccagactcctacgggaggcagcagtggggaatattgcacaatgggcgcaagcctgatgcagcaacgccgcgtgagggacgacggccttcgggttgtaaacctcttttagtagggaagaagcgaaagtgacggtacctgcagaaaaagcaccggctaactacgtgccagcagccgcggtaatacgtagggtgcaagcgttatccggaattattgggcgtaaagagctcgtaggcggtttgtcgcgtctgctgtgaaaactgggggctcaacccccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggaactagatgtaggggccattccacggtttctgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaagacttgacatatacgagaacgggctagaaatagttcactctttggacactcgtaaacaggtggtgcatggttgtcgtcagctcgtgtcgtgagatgttgggttaagtcccgcaacgagcgcaaccctcgttctttgttgccagcacgtaatggtgggaactcaaaggagactgccggggtcaactcggaggaaggtggggatgacgtcaaatcatcatgccccttatgtcttgggcttcacgcatgctacaatggccgatacaaagggctgcaataccgcgaggtggagcgaatcccaaaaagtcggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcccaaccgcaaggagggagctgtcgaaggtgggattggtgattaggactaagtcgtaacaaggtagccgtaccggaaggtgcggctggatcacctcctttcta

SEQ ID NO: 8178 - DNA, 1528 bp, Salinibacterium sp. UTAS2018
  ref <308>: DATABASE ACCESSION NUMBER: NCBI ACCESSION: NZ_CP035375.1
  ref <309>: DATABASE ENTRY DATE: 2019-04-01
  ref <313>: RELEVANT RESIDUES IN SEQ ID NO: (1)..(1528)
tttatggagagtttgatcctggctcaggatgaacgctggcggcgtgcttaacacatgcaagtcgaacgatgaagctggagcttgctctggtggattagtggcgaacgggtgagtaacacgtgagtaacctgcccttgactctggaataagcgttggaaacgacgtctaataccggatacgagcttccgccgcatggtgaggagctggaaagaatttcggtcaaggatggactcgcggcctatcaggtagttggtgaggtaatggctcaccaagcctacgacgggtagccggcctgagagggtgaccggccacactggaactgagacacggtccagactcctacgggaggcagcagtggggaatattgcacaatgggcgcaagcctgatgcagcaacgccgcgtgagggacgacggccttcgggttgtaaacctcttttagtagggaagaagcgaaagtgacggtacctgcagaaaaagcaccggctaactacgtgccagcagccgcggtaatacgtagggtgcaagcgttatccggaattattgggcgtaaagagctcgtaggcggtttgtcgcgtctgctgtgaaaactgggggctcaacccccagcctgcagtgggtacgggcagactagagtgcggtaggggagattggaattcctggtgtagcggtggaatgcgcagatatcaggaggaacaccaatggcgaaggcagatctctgggccgttactgacgctgaggagcgaaagcatggggagcgaacaggattagataccctggtagtccatgccgtaaacgttgggaactagatgtaggggccattccacggtttctgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaagacttgacatatacgagaacgggctagaaatagttcactctttggacactcgtaaacaggtggtgcatggttgtcgtcagctcgtgtcgtgagatgttgggttaagtcccgcaacgagcgcaaccctcgttctttgttgccagcacgtaatggtgggaactcaaaggagactgccggggtcaactcggaggaaggtggggatgacgtcaaatcatcatgccccttatgtcttgggcttcacgcatgctacaatggccgatacaaagggctgcaataccgcgaggtggagcgaatcccaaaaagtcggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaacccgcaaggggaggagctgtcgaaggtgggattggtaattaggactaagtcgtaacaaggtagccgtaccggaaggtgcggctggatcacctcctttcta

SEQ ID NO: 8179 - DNA, 222 bp, Salinicoccus albus
  ref <308>: DATABASE ACCESSION NUMBER: NCBI ACCESSION: NZ_ARQJ01000010.1
  ref <309>: DATABASE ENTRY DATE: 2019-04-01
  ref <313>: RELEVANT RESIDUES IN SEQ ID NO: (1)..(222)
atcatggagagtttgatcctggctcaggatgaacgctggcggcgtgcctaatacatgcaagtcgcacgcggccccggggtgcttgcaccccggcggtcgagtggcggacgggtgagtaacacgtaggcaacctgccccgcagaccgggataaccacgggaaaccgtggctaataccggataacccctggcgccataaggcgccgggttgaaagacggtttcg

SEQ ID NO: 8180 - DNA, 1147 bp, Salinicoccus alkaliphilus
  ref <308>: DATABASE ACCESSION NUMBER: NCBI ACCESSION: NZ_FRCF01000026.1
  ref <309>: DATABASE ENTRY DATE: 2019-04-01
  ref <313>: RELEVANT RESIDUES IN SEQ ID NO: (1)..(1147)
gatcggccacactgggactgagacacggcccagactcctacgggaggcagcagtagggaatcttccgcaatggacgcaagtctgacggagcaacgccgcgtgagtgacgaagggtttcggctcgtaaaactctgttgtcagggaagaacgtccccgtgagtaactgcacggggagtgacggtacctgaccagaaagccacggctaactacgtgccagcagccgcggtaatacgtaggtggcaagcgttatccggaattattgggcgtaaagcgcgcgtaggcggtttcttaagtctgatgtgaaagcccccggctcaaccggggagggtcattggaaactggggaacttgagtgcagaagaggagagtggaattccatgtgtagcggtgaaatgcgcagagatatggaggaacaccagtggcgaaggcggctctctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggttgaaactcaaaggaattgacggggacccgcacaagcggtggagcatgtggtttaattcgaagcaacgcgaagaaccttaccaaatcttgacatcctctgaaccccctggagacagggcttcccttcggggcagagtgacaggtggtgcatggttgtcgtcagctcgtgtcgtgagatgttgggttaagtcccgcaacgagcgcaacccttaaacttagttgccagcattcagttgggcactctaagttgactgccggtgacaaaccggaggaaggtggggatgacgtcaaatcatcatgccccttatgatttgggctacacacgtgctacaatggacaggtgacaaagggcagctacgccgtgaggccaagcgaatcccataaaactgttctcagttcggattggagtctgcaactcgactccatgaagctggaatcgctagtaatcgtggatcagcatgccacggtgaatacgttcccgggtcttgtacacaccgcccgtcacaccacgaaagtcagtaacacctgaagccggtgggccaacctt

SEQ ID NO: 8181 - DNA, 1558 bp, Salinicoccus carnicancri
  ref <308>: DATABASE ACCESSION NUMBER: NCBI ACCESSION: NZ_ANAM01000008.1
  ref <309>: DATABASE ENTRY DATE: 2019-04-01
  ref <313>: RELEVANT RESIDUES IN SEQ ID NO: (1)..(1558)
ttatggagagtttgatcctggctcaggatgaacgctggcggcgtgcctaatacatgcaagtcgaacgcgagaagagggagcttggctccctcggatcgagtggcggacgggtgagtaacacgtaggcaacctgcccatcagccggggataactgcgggaaaccgtggctaataccggataatcctttccaccgcggggtggagagttgaaagacggtttcggctgtcgctgatggatgggcctgcggcgcattagctggttggtggggtaacggcccaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgaagaagggtttcggctcgtaaaactctgttgttgaggaagaacgacaggtagagtaactgctacctgtgtgacggtactcaaccagaaagccacggctaactacgtgccagcagccgcggtaatacgtaggtggcaagcgttatccggaattattgggcgtaaagcgcgcgtaggcggtctgttaagtctgatgtgaaagcccccggctcaaccggggagggtcattggaaactgggagacttgagtgcagaagaggagagtggaattccatgtgtagcggtgaaatgcgcagagatatggaggaacaccagtggcgaaggcggctctctggtctgtaactgacgctgatgtgcgaaagcgtggggatcaaacaggattagataccctggtagtccacgccgtaaacgatgagtgctaagtgttagggggtttccgccccttagtgctgcagcaaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctctgaccgccctggagacagggcttcccttcggggcagagtgacaggtggtgcatggttgtcgtcagctcgtgtcgtgagatgttgggttaagtcccgcaacgagcgcaacccttatgactagttgccagcattgagttgggcactctagtgagactgccggtgacaaaccggaggaaggtggggatgacgtcaaatcatcatgccccttatgatttgggctacacacgtgctacaatggacaggaacaaagggcagcgagaccgcgaggttgagcgaatcccataaaactgttctcagttcggattggagtctgcaactcgactccatgaagctggaatcgctagtaatcgtggatcagaatgccacggtgaatacgttcccgggtcttgtacacaccgcccgtcacaccacgaaagtcagtaacacctgaagccggtgggccaacccttacgggaggcagccgtcgaaggtgggaccgatgattggggtgaagtcgtaacaaggtagccgtatcggaaggtgcggctggatcacctcctttctaagga

SEQ ID NO: 8182 - DNA, 1559 bp, Salinicoccus halodurans
  ref <308>: DATABASE ACCESSION NUMBER: NCBI ACCESSION: NZ_FOTB01000008.1
  ref <309>: DATABASE ENTRY DATE: 2019-04-01
  ref <313>: RELEVANT RESIDUES IN SEQ ID NO: (1)..(1559)
attatggagagtttgatcctggctcaggatgaacgctggcggcgtgcctaatacatgcaagtcgaacgcgagaaggaggagcttgctcctccggatcgagtggcggacgggtgagtaacacgtaggcaacctgcccatcagccggggataactgcgggaaaccgtggctaataccggataatcccgactgtcgatggacggttggttgaaaggcggcctttggctgccgctgatggatgggcctgcggcgcattagctagttggtggggtaagggcccaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgaagaagggtttcggctcgtaaaactctgttgttaaggaagaatgacaggcagagtaactgctgcctgtgtgacggtacttaaccagaaagccacggctaactacgtgccagcagccgcggtaatacgtaggtggcaagcgttatccggaattattgggcgtaaagcgcgcgtaggcggttttttaagtctgatgtgaaagcccccggctcaaccggggagggtcattggaaactggggaacttgagtgcagaagaggagagtggaattccatgtgtagcggtgaaatgcgcagagatatggaggaacaccagtggcgaaggcggctctctggtctgtaactgacgctgatgtgcgaaagcgtggggatcaaacaggattagataccctggtagtccacgccgtaaacgatgagtgctaagtgttagggggtttccgccccttagtgctgcagcaaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctctgacagccatggagacatggtttcccttcggggcagagtgacaggtggtgcatggttgtcgtcagctcgtgtcgtgagatgttgggttaagtcccgcaacgagcgcaacccttattactagttgccagcattcagttgggcactctagtgagactgccggtgacaaaccggaggaaggtggggatgacgtcaaatcatcatgccccttatgatttgggctacacacgtgctacaatgggcaggaacaaagggcagcgagaccgcgaggttcagcgaatcccataaaactgctctcagttcggattggagtctgcaactcgactccatgaagctggaatcgctagtaatcgtggatcagaatgccacggtgaatacgttcccgggtcttgtacacaccgcccgtcacaccacgaaagtcagtaacacctgaagccggtgggccaacccttttgggaggcagccgtcgaaggtgggaccgatgattggggtgaagtcgtaacaaggtagccgtatcggaaggtgcggctggatcacctcctttctaagga

SEQ ID NO: 8183 - DNA, 1560 bp, Salinicoccus kekensis
  ref <308>: DATABASE ACCESSION NUMBER: NCBI ACCESSION: NZ_OBQF01000010.1
  ref <309>: DATABASE ENTRY DATE: 2019-04-01
  ref <313>: RELEVANT RESIDUES IN SEQ ID NO: (1)..(1560)
tttatggagagtttgatcctggctcaggatgaacgctggcggcgtgcctaatacatgcaagtcgagcgcgtcttttgggggcttgcccccataaagacgagcggcggacgggtgagtaacacgtgggcaacctgcccatcagaccgggataaccacgggaaaccgtggctaataccggataatcctttgccacgcaggtggcaaagttgaaagacggtttcggctgtcactgatggatgggcctgcggcgcattagctggttggtggggtaacggcccaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgacgaagggtttcggctcgtaaaactctgttgttaaggaagaacgtccccgtgagtaactgcacggggagtgacggtacttaaccagaaagccacggctaactacgtgccagcagccgcggtaatacgtaggtggcaagcgttatccggaattattgggcgtaaagcgcgcgtaggcggtttcttaagtctgatgtgaaagcccccggctcaaccggggagggtcattggaaactggggaacttgagtgcagaagaggagagtggaattccatgtgtagcggtgaaatgcgcagagatatggaggaacaccagtggcgaaggcggctctctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggttgaaactcaaaggaattgacggggacccgcacaagcggtggagcatgtggtttaattcgaagcaacgcgaagaaccttaccaaatcttgacatcctctgaccgccctggagacagggcttcccttcggggcagagtgacaggtggtgcatggttgtcgtcagctcgtgtcgtgagatgttgggttaagtcccgcaacgagcgcaacccttaagcttagttgccagcattcagttgggcactctaagttgactgccggtgacaaaccggaggaaggtggggatgacgtcaaatcatcatgccccttatgatttgggctacacacgtgctacaatggacaggtgacaaagggcagctacgccgtgaggccaagcgaatcccataaaactgttctcagttcggattggagtctgcaactcgactccatgaagctggaatcgctagtaatcgtggatcagcatgccacggtgaatacgttcccgggtcttgtacacaccgcccgtcacaccacgaaagtcagtaacacctgaagccggtgggccaaccatttatggaggcagccgtcgaaggtgggattgatgattggggtgaagtcgtaacaaggtagccgtatcggaaggtgcggctggatcacctcctttctaagga

SEQ ID NO: 8184 - DNA, 1242 bp, Salinicoccus luteus
  ref <308>: DATABASE ACCESSION NUMBER: NCBI ACCESSION: NZ_JONV01000003.1
  ref <309>: DATABASE ENTRY DATE: 2019-04-01
  ref <313>: RELEVANT RESIDUES IN SEQ ID NO: (1)..(1242)
cttttggctgtcactggtggatgggcctgcggcgcattagctggttggtggggtaacggcccaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaagggtttcggctcgtaaaactctgttgtcagggaagaacgccgacgggagtaactgcccgtcgggtgacggtacctgaccagaaagccacggctaactacgtgccagcagccgcggtaatacgtaggtggcaagcgttatccggaattattgggcgtaaagcgcgcgtaggcggttcgttaagtctgatgtgaaagcccccggctcaaccggggagggtcattggaaactggcggacttgagtgcagaagaggagagtggaattccatgtgtagcggtgaaatgcgcagagatatggaggaacaccagtggcgaaggcggctctctggtctgcaactgacgctgaggtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggttgaaactcaaaggaattgacggggacccgcacaagcggtggagcatgtggtttaattcgaagcaacgcgaagaaccttaccaaatcttgacatcctctgaccaccctggagacagggtttcccttcggggcagagtgacaggtggtgcatggttgtcgtcagctcgtgtcgtgagatgttgggttaagtcccgcaacgagcgcaacccttattactagttgccagcattcagttgggcactctagtgagactgccggtgacaaaccggaggaaggtggggatgacgtcaaatcatcatgccccttatgatttgggctacacacgtgctacaatggacaggttacaaagggcagctacgccgcgaggccaagcgaatcccataaaactgttctcagttcggattggagtctgcaactcgactccatgaagctggaatcgctagtaatcgtggatcagaatgccacggtgaatacgttcccgggtcttgtacacaccgcccgtcacaccacgaaagtcggtaacacctgaagccggtgggccaacc

SEQ ID NO: 8185 - DNA, 1556 bp, Salinicoccus qingdaonensis
  ref <308>: DATABASE ACCESSION NUMBER: NCBI ACCESSION: NZ_FNFY01000063.1
  ref <309>: DATABASE ENTRY DATE: 2019-04-01
  ref <313>: RELEVANT RESIDUES IN SEQ ID NO: (1)..(1556)
tttatggagagtttgatcctggctcaggatgaacgctggcggcgtgcctaatacatgcaagtcgagcgcgagattggggagcttgctccccatgatcgagcggcggacgggtgagtaacacgtaggcaacctacccatcagactgggataaccgcgggaaaccgtggctaataccggatgaccctttatgacaccggtcgtaaagttgaaaggcgcttatggtgccgctgatggatgggcctgcggcgcattagctggttggtggggtaacggcccaccaaggcgacgatgcgtagccgacctgagagggtgatcggccacactgggactgagacacggcccagactcctacgggaggcagcagtagggaatcttccgcaatggacgcaagtctgacggagcaacgccgcgtgagtgaagaagggtttcggctcgtaaaactctgttgttaaggaagaatgtcatgtatttaactgatatgtgagtgacggtacttaaccagaaagccacggctaactacgtgccagcagccgcggtaatacgtaggtggcaagcgttatccggaattattgggcgtaaagcgcgcgtaggcggtttcttaagtctgatgtgaaagcccccggctcaaccggggagggtcattggaaactggggaacttgagtgcagaagaggagagtggaattccatgtgtagcggtgaaatgcgcagagatatggaggaacaccagtggcgaaggcggctctctggtctgtaactgacgctgatgtgcgaaagcgtggggatcaaacaggattagataccctggtagtccacgccgtaaacgatgagtgctaagtgttagggggtttccgccccttagtgctgcagcaaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgaccgccctggagacagggcttcccttcggggcagagagacaggtggtgcatggttgtcgtcagctcgtgtcgtgagatgttgggttaagtcccgcaacgagcgcaacccttaagcttagttgccagcattcagttgggcactctaagttgactgccggtgacaaaccggaggaaggtggggatgacgtcaaatcatcatgccccttatgatttgggctacacacgtgctacaatggacaggttacaaagggcagcgacgccgcaaggccaagcgaatcccataaaactgttctcagttcggattggagtctgcaactcgactccatgaagctggaatcgctagtaatcgtggatcagcatgccacggtgaatacgttcccgggtcttgtacacaccgcccgtcacaccacgaaagtcagtaacacctgaagccggtgggccaaccattatggaggcagccgtcgaaggtgggattgatgattggggtgaagtcgtaacaaggtagccgtatcggaaggtgcggctggatcacctcctttctaagga

SEQ ID NO: 8186 - DNA, 1356 bp, Salinicoccus roseus
  ref <308>: DATABASE ACCESSION NUMBER: NCBI ACCESSION: NZ_RKQJ01000005.1
  ref <309>: DATABASE ENTRY DATE: 2019-04-01
  ref <313>: RELEVANT RESIDUES IN SEQ ID NO: (1)..(1356)
aaagttgaaaggcggcttcggctgtcactgatggatgggcctgcggcgcattagctggttggtggggtaacggcccaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaagggtttcggctcgtaaaactctgttgtcagggaagaacgccgacgggagtaactgcccgtcgggtgacggtacctgaccagaaagccacggctaactacgtgccagcagccgcggtaatacgtaggtggcaagcgttatccggaattattgggcgtaaagcgcgcgtaggcggttcgttaagtctgatgtgaaagcccccggctcaaccggggagggtcattggaaactggcggacttgagtgcagaagaggagagtggaattccatgtgtagcggtgaaatgcgcagagatatggaggaacaccagtggcgaaggcggctctctggtctgcaactgacgctgaggtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggttgaaactcaaaggaattgacggggacccgcacaagcggtggagcatgtggtttaattcgaagcaacgcgaagaaccttaccaaatcttgacatcctctgaccaccctggagacagggtttcccttcggggcagagtgacaggtggtgcatggttgtcgtcagctcgtgtcgtgagatgttgggttaagtcccgcaacgagcgcaacccttatcattagttgccagcattcagttgggcactctaatgagactgccggtgacaaaccggaggaaggtggggatgacgtcaaatcatcatgccccttatgatttgggctacacacgtgctacaatggacaggttacaaagggcagctaagccgcgaggccaagcgaatcccataaaactgttctcagttcggattggagtctgcaactcgactccatgaagctggaatcgctagtaatcgtggatcagaatgccacggtgaatacgttcccgggtcttgtacacaccgcccgtcacaccacgaaagtcggtaacacctgaagccggtgggccaacctcttggaggcagccgtcgaaggtgggaccgatgattggggtgaagtcgtaacaaggtagccgtatcggaaggtgcggctggatcacctcctttctaagga

SEQ ID NO: 8187 - DNA, 750 bp, Salinicoccus sediminis
  ref <308>: DATABASE ACCESSION NUMBER: NCBI ACCESSION: NZ_LAYZ01000025.1
  ref <309>: DATABASE ENTRY DATE: 2019-04-01
  ref <313>: RELEVANT RESIDUES IN SEQ ID NO: (1)..(750)
ttatggagagtttgatcctggctcaggatgaacgctggcggcgtgcctaatacatgcaagtcgaacgcgagaggagggagcttgctccctctgatcgagtggcggacgggtgagtaacacgtaggcaacctgcccatcagtccgggataaccgcgggaaaccgtggctaataccggatgatcctctccaccgcggggtggggagttgaaagacggtttcggctgtcgctgatggatgggcctgcggcgcattagctggttggcggggtaacggcccaccaaggcaacgatgcgtagccgacctgagagggtgatcggccacactgggactgagacacggcccagactcctacgggaggcagcagtagggaatcttccgcaatggacgcaagtctgacggagcaacgccgcgtgagtgaagaagggtttcggctcgtaaaactctgttgttaaggaagaacgacaggtagagtaactgctacctgtgtgacggtacttaaccagaaagccacggctaactacgtgccagcagccgcggtaatacgtaggtggcaagcgttatccggaattattgggcgtaaagcgcgcgtaggcggtcttttaagtctgatgtgaaagcccccggctcaaccggggagggtcattggaaactgggagacttgagtgcagaagaggagagtggaattccatgtgtagcggtgaaatgcgcagagatatggaggaacaccagtggcgaaggcggctctctggt

SEQ ID NO: 8188 - DNA, 1543 bp, Salinicola acroporae
  ref <308>: DATABASE ACCESSION NUMBER: NCBI ACCESSION: NZ_PZJW01000013.1
  ref <309>: DATABASE ENTRY DATE: 2019-04-01
  ref <313>: RELEVANT RESIDUES IN SEQ ID NO: (1)..(1543)
aaactgaagagtttgatcatggctcagattgaacgctggcggcaggcctaacacatgcaagtcgagcggcagcacggggagcttgctccctggtggcgagcggcggacgggtgagtaatgcataggaatctgcccggtagtgggggataacgtggggaaacccacgctaataccgcatacgtcctacgggagaaagcggaggatcttcggacttcgcgctatcggatgagcctatgtcggattagctagttggtaaggtaacggcttaccaaggcgacgatccgtagctggtctgagaggatgatcagccacactgggactgagacacggcccagactcctacgggaggcagcagtggggaatattggacaatgggcgaaagcctgatccagccatgccgcgtgtgtgaagaaggctttcgggttgtaaagcactttcagcgaggaagaaagcctggtggttaatacccatcaggaaggacatcactcgcagaagaagcaccggctaactccgtgccagcagccgcggtaatacggagggtgcgagcgttaatcggaattactgggcgtaaagcgcgcgtaggtggcttggcacgccggttgtgaaagccccgggctcaacctgggaacggcatccggaacggccaggctagagtgcaggagaggaaggtagaattcccggtgtagcggtgaaatgcgtagagatcgggaggaataccagtggcgaaggcggccttctggcctgacactgacactgaggtgcgaaagcgtgggtagcaaacaggattagataccctggtagtccacgccgtaaacgatgtcgactagccgttgggacctttaaggacttagtggcgcagttaacgcgataagtcgaccgcctggggagtacggccgcaaggttaaaactcaaatgaattgacgggggcccgcacaagcggtggagcatgtggtttaattcgatgcaacgcgaagaaccttacctacccttgacatccagagaactttccagagatggattggtgccttcgggaactctgagacaggtgctgcatggctgtcgtcagctcgtgttgtgaaatgttgggttaagtcccgtaacgagcgcaacccttgtccttatttgccagcgattcggtcgggaactctaaggagactgccggtgacaaaccggaggaaggtggggacgacgtcaagtcatcatggcccttacgggtagggctacacacgtgctacaatggccggtacaaagggttgcgagaccgcgaggtggagcgaatcccagaaagccggcctcagtccggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcttaaccttcgggagagcgatcaccacggtgtggttcatgactggggtgaagtcgtaacaaggtagccgtaggggaacctgcggctggatcacctccttaaac

SEQ ID NO: 8189 - DNA, 1543 bp, Salinicola halophilus
  ref <308>: DATABASE ACCESSION NUMBER: NCBI ACCESSION: NZ_PZJV01000010.1
  ref <309>: DATABASE ENTRY DATE: 2019-04-01
  ref <313>: RELEVANT RESIDUES IN SEQ ID NO: (1)..(1543)
aaactgaagagtttgatcatggctcagattgaacgctggcggcaggcctaacacatgcaagtcgagcggcagcacggggagcttgctccctggtggcgagcggcggacgggtgagtaatgcataggaatctgcccggtagtgggggataacgtggggaaacccacgctaataccgcatacgtcctacgggagaaagcggaggatcttcggacttcgcgctatcggatgagcctatgtcggattagctagttggtaaggtaacggcttaccaaggcgacgatccgtagctggtctgagaggatgatcagccacactgggactgagacacggcccagactcctacgggaggcagcagtggggaatattggacaatgggcgaaagcctgatccagccatgccgcgtgtgtgaagaaggctttcgggttgtaaagcactttcagcgaggaagaaagcctgtcggttaatacccggcaggaacgacatcactcgcagaagaagcaccggctaactccgtgccagcagccgcggtaatacggagggtgcgagcgttaatcggaattactgggcgtaaagcgcgcgtaggtggcttggcacgccaggtgtgaaagccccgggctcaacctgggaacggcatctggaacggccaagctagagtgcaggagaggaaggtggaattcccggtgtagcggtgaaatgcgtagagatcgggaggaataccagtggcgaaggcggccttctggcctgacactgacactgaggtgcgaaagcgtgggtagcaaacaggattagataccctggtagtccacgccgtaaacgatgtcgactagccgttgggacctttaaggacttagtggcgcagttaacgcgataagtcgaccgcctggggagtacggccgcaaggttaaaactcaaatgaattgacgggggcccgcacaagcggtggagcatgtggtttaattcgatgcaacgcgaagaaccttacctacccttgacatcctgcgaacccggaagagattccggggtgccttcgggaacgcagtgacaggtgctgcatggctgtcgtcagctcgtgttgtgaaatgttgggttaagtcccgtaacgagcgcaacccttgtccttatttgccagcgattcggtcgggaactctaaggagactgccggtgacaaaccggaggaaggtggggacgacgtcaagtcatcatggcccttacgggtagggctacacacgtgctacaatggccggtacaaagggttgcgagaccgcgaggtggagcgaatcccataaagccggcctcagtccggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcttaaccttcgggagagcgatcaccacggtgtggttcatgactggggtgaagtcgtaacaaggtagccgtaggggaacctgcggctggatcacctccttaaac

SEQ ID NO: 8190 - DNA, 1542 bp, Salinicola peritrichatus
  ref <308>: DATABASE ACCESSION NUMBER: NCBI ACCESSION: NZ_PZJU01000035.1
  ref <309>: DATABASE ENTRY DATE: 2019-04-01
  ref <313>: RELEVANT RESIDUES IN SEQ ID NO: (1)..(1542)
aactgaagagtttgatcatggctcagattgaacgctggcggcaggcctaacacatgcaagtcgagcggcagcacggggagcttgctccctggtggcgagcggcggacgggtgagtaacgcataggaatctgcccggtagtgggggataacctggggaaacccaggctaataccgcatacgtcccacgggagaaagcgggggctcttcggacctcgcgctatcggatgagcctatgtcggattagctggttggtgaggtaacggctcaccaaggcgacgatccgtagctggtctgagaggatgatcagccacactgggactgagacacggcccagactcctacgggaggcagcagtggggaatattggacaatgggcgcaagcctgatccagccatgccgcgtgtgtgaagaaggctttcgggttgtaaagcactttcagtggggaagaaagcttgccggccaatacccggcaagaaggacatcacccacagaagaagcaccggctaactccgtgccagcagccgcggtaatacggagggtgcgagcgttaatcggaattactgggcgtaaagcgcgcgtaggtggcttggcacgccggttgtgaaagccccgggctcaacctgggaaccgcatccggaacggccaggctagagtgcaggagaggaaggtagaattcccggtgtagcggtgaaatgcgtagagatcgggaggaataccagtggcgaaggcggccttctggcctgacactgacactgaggtgcgaaagcgtgggtagcaaacaggattagataccctggtagtccacgccgtaaacgatgtcgactagccgttgggacctttaaggacttagtggcgcagttaacgcgataagtcgaccgcctggggagtacggccgcaaggttaaaactcaaatgaattgacgggggcccgcacaagcggtggagcatgtggtttaattcgatgcaacgcgaagaaccttacctacccttgacatccagagaacttggcagagatgccttggtgccttcgggagctctgagacaggtgctgcatggctgtcgtcagctcgtgttgtgaaatgttgggttaagtcccgtaacgagcgcaacccttgtccctatttgccagcgattcggtcgggaactctagggagactgccggtgacaaaccggaggaaggtggggacgacgtcaagtcatcatggcccttacgggtagggctacacacgtgctacaatggccggtacaaagggttgcgaagcggcgacgtggagcgaatcccagaaagccggcctcagtccggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcttaaccttcgggggagcgatcaccacggtgtggttcatgactggggtgaagtcgtaacaaggtagccgtaggggaacctgcggctggatcacctccttaaac

SEQ ID NO: 8191 - DNA, 1544 bp, Salinicola salarius
  ref <308>: DATABASE ACCESSION NUMBER: NCBI ACCESSION: NZ_PZJT01000030.1
  ref <309>: DATABASE ENTRY DATE: 2019-04-01
  ref <313>: RELEVANT RESIDUES IN SEQ ID NO: (1)..(1544)
aaactgaagagtttgatcatggctcagattgaacgctggcggcaggcctaacacatgcaagtcgagcggcagcacggggagcttgctccctggtggcgagcggcggacgggtgagtaatgcataggaatctgcccggtagtgggggataacgtggggaaacccacgctaataccgcatacgtcctacgggagaaagcggaggatcttcggacttcgcgctatcggatgagcctatgtcggattagctagttggtaaggtaacggcttaccaaggcgacgatccgtagctggtctgagaggatgatcagccacactgggactgagacacggcccagactcctacgggaggcagcagtggggaatattggacaatgggcgaaagcctgatccagccatgccgcgtgtgtgaagaaggctttcgggttgtaaagcactttcagcgaggaagaaagcctctggattaataccccagaggaaggacatcactcgcagaagaagcaccggctaactccgtgccagcagccgcggtaatacggagggtgcgagcgttaatcggaattactgggcgtaaagcgcgcgtaggtggcttggcacgccggttgtgaaagccccgggctcaacctgggaacggcatccggaacggccaggctagagtgcaggagaggaaggtagaattcccggtgtagcggtgaaatgcgtagagatcgggaggaataccagtggcgaaggcggccttctggcctgacactgacactgaggtgcgaaagcgtgggtagcaaacaggattagataccctggtagtccacgccgtaaacgatgtcgactagccgttgggacctttaaggacttagtggcgcagttaacgcgataagtcgaccgcctggggagtacggccgcaaggttaaaactcaaatgaattgacgggggcccgcacaagcggtggagcatgtggtttaattcgatgcaacgcgaagaaccttacctacccttgacatccagagaagttggcagagatgccttcgtgccttcgggaactctgagacaggtgctgcatggctgtcgtcagctcgtgttgtgaaatgttgggttaagtcccgtaacgagcgcaacccttgtccttatttgccagcgagtaaagtcgggaactctaaggagactgccggtgacaaaccggaggaaggtggggacgacgtcaagtcatcatggcccttacgggtagggctacacacgtgctacaatggccggtacaaagggttgcgagaccgcgaggtggagcgaatcccagaaagccggcctcagtccggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcttaaccttcgggagagcgatcaccacggtgtggttcatgactggggtgaagtcgtaacaaggtagccgtaggggaacctgcggctggatcacctccttaaac

SEQ ID NO: 8192 - DNA, 1544 bp, Salinicola socius
  ref <308>: DATABASE ACCESSION NUMBER: NCBI ACCESSION: NZ_PZJS01000024.1
  ref <309>: DATABASE ENTRY DATE: 2019-04-01
  ref <313>: RELEVANT RESIDUES IN SEQ ID NO: (1)..(1544)
aaactgaagagtttgatcatggctcagattgaacgctggcggcaggcctaacacatgcaagtcgagcggcagcacggggagcttgctccctggtggcgagcggcggacgggtgagtaatgcataggaatctgcccgatagtgggggataacgtggggaaacccacgctaataccgcatacgtcctacgggagaaagcggaggatcttcggacttcgcgctatcggatgagcctatgtcggattagctagttggtaaggtaacggcttaccaaggcgacgatccgtagctggtctgagaggatgatcagccacactgggactgagacacggcccagactcctacgggaggcagcagtggggaatattggacaatgggcgaaagcctgatccagccatgccgcgtgtgtgaagaaggctttcgggttgtaaagcactttcagcgaggaagaaagcctttgggttaataccccagaggaaggacatcactcgcagaagaagcaccggctaactccgtgccagcagccgcggtaatacggagggtgcgagcgttaatcggaattactgggcgtaaagcgcgcgtaggtggcttggcacgccggttgtgaaagccccgggctcaacctgggaactgcatccggaacggccaggctagagtgcaggagaggaaggtagaattcccggtgtagcggtgaaatgcgtagagatcgggaggaataccagtggcgaaggcggccttctggcctgacactgacactgaggtgcgaaagcgtgggtagcaaacaggattagataccctggtagtccacgccgtaaacgatgtcgactagccgttgggacctttaaggacttagtggcgcagttaacgcgataagtcgaccgcctggggagtacggccgcaaggttaaaactcaaatgaattgacgggggcccgcacaagcggtggagcatgtggtttaattcgatgcaacgcgaagaaccttacctacccttgacatccagagaactttccagagatggattggtgccttcgggaactctgagacaggtgctgcatggctgtcgtcagctcgtgttgtgaaatgttgggttaagtcccgtaacgagcgcaacccttgtccttatttgccagcacgtaatggtgggaactctaaggagactgccggtgacaaaccggaggaaggtggggacgacgtcaagtcatcatggcccttacgggtagggctacacacgtgctacaatggccggtacaaagggttgcgagatcgcgagatggagcgaatcccagaaagccggcctcagttcggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcttaaccttcgggagagcgatcaccacggtgtggttcatgactggggtgaagtcgtaacaaggtagccgtaggggaacctgcggctggatcacctccttaaac

SEQ ID NO: 8193 - DNA, 1544 bp, Salinicola sp. CPA57; identical to SEQ ID NO: 8192
  ref <308>: DATABASE ACCESSION NUMBER: NCBI ACCESSION: NZ_PZJR01000022.1
  ref <309>: DATABASE ENTRY DATE: 2019-04-01
  ref <313>: RELEVANT RESIDUES IN SEQ ID NO: (1)..(1544)

SEQ ID NO: 8194 - DNA, 1544 bp, Salinicola sp. CPA60
  ref <308>: DATABASE ACCESSION NUMBER: NCBI ACCESSION: NZ_PZJQ01000008.1
  ref <309>: DATABASE ENTRY DATE: 2019-04-01
  ref <313>: RELEVANT RESIDUES IN SEQ ID NO: (1)..(1544)
aaactgaagagtttgatcatggctcagattgaacgctggcggcaggcctaacacatgcaagtcgagcggcagcacggggagcttgctccctggtggcgagcggcggacgggtgagtaatgcataggaatctgcccgatagtgggggataacgtggggaaacccacgctaataccgcatacgtcctacgggagaaagcggaggatcttcggacttcgcgctatcggatgagcctatgtcggattagctagttggtaaggtaatggcttaccaaggcgacgatccgtagctggtctgagaggatgatcagccacactgggactgagacacggcccagactcctacgggaggcagcagtggggaatattggacaatgggcgaaagcctgatccagccatgccgcgtgtgtgaagaaggctttcgggttgtaaagcactttcagcgaggaagaaagcctctgggttaataccctggaggaaggacatcactcgcagaagaagcaccggctaactccgtgccagcagccgcggtaatacggagggtgcgagcgttaatcggaattactgggcgtaaagcgcgcgtaggtggcttggcacgccggttgtgaaagccccgggctcaacctgggaacggcatccggaacggccaggctagagtgcaggagaggaaggtagaattcccggtgtagcggtgaaatgcgtagagatcgggaggaataccagtggcgaaggcggccttctggcctgacactgacactgaggtgcgaaagcgtgggtagcaaacaggattagataccctggtagtccacgccgtaaacgatgtcgactagccgttgggacctttaaggacttagtggcgcagttaacgcgataagtcgaccgcctggggagtacggccgcaaggttaaaactcaaatgaattgacgggggcccgcacaagcggtggagcatgtggtttaattcgatgcaacgcgaagaaccttacctacccttgacatccagagaagttggcagagatgccttcgtgccttcgggaactctgagacaggtgctgcatggctgtcgtcagctcgtgttgtgaaatgttgggttaagtcccgtaacgagcgcaacccttgtccttatttgccagcacgtaatggtgggaactctaaggagactgccggtgacaaaccggaggaaggtggggacgacgtcaagtcatcatggcccttacgggtagggctacacacgtgctacaatggccggtacaaagggctgcgagatcgcgagatggagcgaatcccagaaagccggcctcagttcggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcttaaccttcgggagagcgatcaccacggtgtggttcatgactggggtgaagtcgtaacaaggtagccgtaggggaacctgcggctggatcacctccttaaac

SEQ ID NO: 8195 - DNA, 1543 bp, Salinicola sp. CPA62
  ref <308>: DATABASE ACCESSION NUMBER: NCBI ACCESSION: NZ_PZJP01000021.1
  ref <309>: DATABASE ENTRY DATE: 2019-04-01
  ref <313>: RELEVANT RESIDUES IN SEQ ID NO: (1)..(1543)
aaactgaagagtttgatcatggctcagattgaacgctggcggcaggcctaacacatgcaagtcgagcggcagcacggggagcttgctccctggtggcgagcggcggacgggtgagtaatgcataggaatctgcccggtagtgggggataacgtggggaaacccacgctaataccgcatacgtcctacgggagaaagcggaggatcttcggacttcgcgctatcggatgagcctatgtcggattagctagttggtaaggtaacggcttaccaaggcgacgatccgtagctggtctgagaggatgatcagccacactgggactgagacacggcccagactcctacgggaggcagcagtggggaatattggacaatgggcgaaagcctgatccagccatgccgcgtgtgtgaagaaggctttcgggttgtaaagcactttcagcgaggaagaaagcctgtcggttaatacccgacaggaacgacatcactcgcagaagaagcaccggctaactccgtgccagcagccgcggtaatacggagggtgcgagcgttaatcggaattactgggcgtaaagcgcgcgtaggtggcttggcacgccggttgtgaaagccccgggctcaacctgggaactgcatccggaacggccaggctagagtgcaggagaggaaggtggaattcccggtgtagcggtgaaatgcgtagagatcgggaggaataccagtggcgaaggcggccttctggcctgacactgacactgaggtgcgaaagcgtgggtagcaaacaggattagataccctggtagtccacgccgtaaacgatgtcgactagccgttgggacctttaaggacttagtggcgcagttaacgcgataagtcgaccgcctggggagtacggccgcaaggttaaaactcaaatgaattgacgggggcccgcacaagcggtggagcatgtggtttaattcgatgcaacgcgaagaaccttacctacccttgacatcctgcgaacttgtgagagatcacttggtgccttcgggagcgcagtgacaggtgctgcatggctgtcgtcagctcgtgttgtgaaatgttgggttaagtcccgtaacgagcgcaacccttgtccttatttgccagcgattcggtcgggaactctaaggagactgccggtgacaaaccggaggaaggtggggacgacgtcaagtcatcatggcccttacgggtagggctacacacgtgctacaatggccggtacaaagggttgcgagaccgcgaggtggagcgaatcccataaagccggcctcagtccggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcttaaccttcgggagagcgatcaccacggtgtggttcatgactggggtgaagtcgtaacaaggtagccgtaggggaacctgcggctggatcacctccttaaac

SEQ ID NO: 8196 - DNA, 1543 bp, Salinicola sp. CPA92
  ref <308>: DATABASE ACCESSION NUMBER: NCBI ACCESSION: NZ_PZJO01000016.1
  ref <309>: DATABASE ENTRY DATE: 2019-04-01
  ref <313>: RELEVANT RESIDUES IN SEQ ID NO: (1)..(1543)
taactgaagagtttgatcatggctcagattgaacgctggcggcaggcctaacacatgcaagtcgagcggcagcacggggagcttgctccctggtggcgagcggcggacgggtgagtaatgcataggaatctgcccggtagtgggggataacctggggaaacccaggctaataccgcatacgtcctacgggagaaagcaggggatcttcggaccttgcgctatcggatgagcctatgtcggattagctggttggtgaggtaatggctcaccaaggcgacgatccgtagctggtctgagaggatgatcagccacactgggactgagacacggcccagactcctacgggaggcagcagtggggaatattggacaatgggcgcaagcctgatccagccatgccgcgtgtgtgaagaaggccctcgggttgtaaagcactttcagcgaggaagaaggcttggcggtcaatacccgtcaagaaggacatcactcgcagaagaagcaccggctaactccgtgccagcagccgcggtaatacggagggtgcgagcgttaatcggaattactgggcgtaaagcgcgcgtaggtggtttggcacgccggttgtgaaagccccgggctcaacctgggaacggcatccggaacggccagactagagtgcaggagaggaaggtagaattcccggtgtagcggtgaaatgcgtagagatcgggaggaataccagtggcgaaggcggccttctggcctgacactgacactgaggtgcgaaagcgtgggtagcaaacaggattagataccctggtagtccacgccgtaaacgatgtcgactagccgttgggacctttaaggacttagtggcgcagttaacgcgataagtcgaccgcctggggagtacggccgcaaggttaaaactcaaatgaattgacgggggcccgcacaagcggtggagcatgtggtttaattcgatgcaacgcgaagaaccttacctacccttgacatccagagaacttggcagagatgccttggtgccttcgggaactctgagacaggtgctgcatggctgtcgtcagctcgtgttgtgaaatgttgggttaagtcccgtaacgagcgcaacccttgtccctatttgccagcgattcggtcgggaactctagggagactgccggtgacaaaccggaggaaggtggggacgacgtcaagtcatcatggcccttacgggtagggctacacacgtgctacaatggccggtacaaagggttgcgagaccgcgaggtggagcgaatcccagaaagccggcctcagtccggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcttaaccttcgggggagcgatcaccacggtgtggttcatgactggggtgaagtcgtaacaaggtagccgtaggggaacctgcggctggatcacctccttaaac

SEQ ID NO: 8197 - DNA, 1544 bp, Salinicola sp. CR45
  ref <308>: DATABASE ACCESSION NUMBER: NCBI ACCESSION: NZ_PZJN01000022.1
  ref <309>: DATABASE ENTRY DATE: 2019-04-01
  ref <313>: RELEVANT RESIDUES IN SEQ ID NO: (1)..(1544)
aaactgaagagtttgatcatggctcagattgaacgctggcggcaggcctaacacatgcaagtcgagcggcagcacggggagcttgctccctggtggcgagcggcggacgggtgagtaatgcataggaatctgcccggtagtgggggataacgtggggaaacccacgctaataccgcatacgtcctacgggagaaagcggaggatcttcggacttcgcgctatcggatgagcctatgtcggattagctagttggtaaggtaacggcttaccaaggcgacgatccgtagctggtctgagaggatgatcagccacactgggactgagacacggcccagactcctacgggaggcagcagtggggaatattggacaatgggcgaaagcctgatccagccatgccgcgtgtgtgaagaaggctttcgggttgtaaagcactttcagcgaggaagaaagcctctgggttaataccctagaggaacgacatcactcgcagaagaagcaccggctaactccgtgccagcagccgcggtaatacggagggtgcgagcgttaatcggaattactgggcgtaaagcgcgcgtaggtggcttggcacgccggttgtgaaagccccgggctcaacctgggaacggcatccggaacggccaggctagagtgcaggagaggaaggtagaattcccggtgtagcggtgaaatgcgtagagatcgggaggaataccagtggcgaaggcggccttctggcctgacactgacactgaggtgcgaaagcgtgggtagcaaacaggattagataccctggtagtccacgccgtaaacgatgtcgactagccgttgggacctttaaggacttagtggcgcagttaacgcgataagtcgaccgcctggggagtacggccgcaaggttaaaactcaaatgaattgacgggggcccgcacaagcggtggagcatgtggtttaattcgatgcaacgcgaagaaccttacctacccttgacatccagagaagttggcagagatgccttcgtgccttcgggagctctgagacaggtgctgcatggctgtcgtcagctcgtgttgtgaaatgttgggttaagtcccgtaacgagcgcaacccttgtccttatttgccagcgagtaatgtcgggaactctaaggagactgccggtgacaaaccggaggaaggtggggacgacgtcaagtcatcatggcccttacgggtagggctacacacgtgctacaatggccggtacaaagggctgcgagatcgcgagatggagcgaatcccagaaagccggcctcagttcggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcttaaccttcgggagagcgatcaccacggtgtggttcatgactggggtgaagtcgtaacaaggtagccgtaggggaacctgcggctggatcacctccttaaac

SEQ ID NO: 8198 - DNA, 1543 bp, Salinicola sp. CR50
  ref <308>: DATABASE ACCESSION NUMBER: NCBI ACCESSION: NZ_PZJM01000020.1
  ref <309>: DATABASE ENTRY DATE: 2019-04-01
  ref <313>: RELEVANT RESIDUES IN SEQ ID NO: (1)..(1543)
aaactgaagagtttgatcatggctcagattgaacgctggcggcaggcctaacacatgcaagtcgagcggcagcacggggagcttgctccctggtggcgagcggcggacgggtgagtaatgcataggaatctgcccggtagtgggggataacgtggggaaacccacgctaataccgcatacgtcctacgggagaaagcggaggatcttcggacttcgcgctatcggatgagcctatgtcggattagctagttggtaaggtaacggcttaccaaggcgacgatccgtagctggtctgagaggatgatcagccacactgggactgagacacggcccagactcctacgggaggcagcagtggggaatattggacaatgggcgaaagcctgatccagccatgccgcgtgtgtgaagaaggctttcgggttgtaaagcactttcagcgaggaagaaagcctctgggttaataccccagaggaaggacatcactcgcagaagaagcaccggctaactccgtgccagcagccgcggtaatacggagggtgcgagcgttaatcggaattactgggcgtaaagcgcgcgtaggtggcttggcacgccggttgtgaaagccccgggctcaacctgggaacggcatccggaacggccaggctagagtgcaggagaggaaggtagaattcccggtgtagcggtgaaatgcgtagagatcgggaggaataccagtggcgaaggcggccttctggcctgacactgacactgaggtgcgaaagcgtgggtagcaaacaggattagataccctggtagtccacgccgtaaacgatgtcgactagccgttgggacctttaaggacttagtggcgcagttaacgcgataagtcgaccgcctggggagtacggccgcaaggttaaaactcaaatgaattgacgggggcccgcacaagcggtggagcatgtggtttaattcgatgcaacgcgaagaaccttacctacccttgacatccagaggactttccagagatggattggtgccttcgggaactctgagacaggtgctgcatggctgtcgtcagctcgtgttgtgaaatgttgggttaagtcccgtaacgagcgcaacccttgtccttatttgccagcgattcggtcgggaactctaaggagactgccggtgacaaaccggaggaaggtggggacgacgtcaagtcatcatggcccttacgggtagggctacacacgtgctacaatggccggtacaaagggttgcgagaccgcgaggtggagcgaatcccagaaagccggcctcagtccggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcttaaccttcgggagagcgatcaccacggtgtggttcatgactggggtgaagtcgtaacaaggtagccgtaggggaacctgcggctggatcacctccttaaac

SEQ ID NO: 8199 - DNA, 1543 bp, Salinicola sp. CR57
  ref <308>: DATABASE ACCESSION NUMBER: NCBI ACCESSION: NZ_PZJL01000019.1
  ref <309>: DATABASE ENTRY DATE: 2019-04-01
  ref <313>: RELEVANT RESIDUES IN SEQ ID NO: (1)..(1543)
aaactgaagagtttgatcatggctcagattgaacgctggcggcaggcctaacacatgcaagtcgagcggcagcacggggagcttgctccctggtggcgagcggcggacgggtgagtaatgcataggaatctgcccggtagtgggggataacgtggggaaacccacgctaataccgcatacgtcctacgggagaaagcggaggatcttcggacttcgcgctatcggatgagcctatgtcggattagctagttggtaaggtaacggcttaccaaggcgacgatccgtagctggtctgagaggatgatcagccacactgggactgagacacggcccagactcctacgggaggcagcagtggggaatattggacaatgggcgaaagcctgatccagccatgccgcgtgtgtgaagaaggctttcgggttgtaaagcactttcagcgaggaagaaggcctctgggttaataccccagaggaaggacatcactcgcagaagaagcaccggctaactccgtgccagcagccgcggtaatacggagggtgcgagcgttaatcggaattactgggcgtaaagcgcgcgtaggtggcttggcacgccggttgtgaaagccccgggctcaacctgggaacggcatccggaacggccaggctagagtgcaggagaggaaggtagaattcccggtgtagcggtgaaatgcgtagagatcgggaggaataccagtggcgaaggcggccttctggcctgacactgacactgaggtgcgaaagcgtgggtagcaaacaggattagataccctggtagtccacgccgtaaacgatgtcgactagccgttgggacctttaaggacttagtggcgcagttaacgcgataagtcgaccgcctggggagtacggccgcaaggttaaaactcaaatgaattgacgggggcccgcacaagcggtggagcatgtggtttaattcgatgcaacgcgaagaaccttacctacccttgacatccagagaactttccagagatggattggtgccttcgggaactctgagacaggtgctgcatggctgtcgtcagctcgtgttgtgaaatgttgggttaagtcccgtaacgagcgcaacccttgtccttatttgccagcgattcggtcgggaactctaaggagactgccggtgacaaaccggaggaaggtggggacgacgtcaagtcatcatggcccttacgggtagggctacacacgtgctacaatggccggtacaaagggttgcgagaccgcgaggtggagcgaatcccagaaagccggcctcagtccggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcttaaccttcgggagagcgatcaccacggtgtggttcatgactggggtgaagtcgtaacaaggtagccgtaggggaacctgcggctggatcacctccttaaac

SEQ ID NO: 8200 - DNA, 1543 bp, Salinicola sp. RZ23
  ref <308>: DATABASE ACCESSION NUMBER: NCBI ACCESSION: NZ_PZJK01000028.1
  ref <309>: DATABASE ENTRY DATE: 2019-04-01
  ref <313>: RELEVANT RESIDUES IN SEQ ID NO: (1)..(1543)
taactgaagagtttgatcatggctcagattgaacgctggcggcaggcctaacacatgcaagtcgagcggcagcacggggagcttgctccctggtggcgagcggcggacgggtgagtaatgcataggaatctgcccggtagtgggggataacctggggaaacccaggctaataccgcatacgtcctacgggagaaagcaggggatcttcggaccttgcgctatcggatgagcctatgtcggattagctggttggtgaggtaatggctcaccaaggcgacgatccgtagctggtctgagaggatgatcagccacactgggactgagacacggcccagactcctacgggaggcagcagtggggaatattggacaatgggcgcaagcctgatccagccatgccgcgtgtgtgaagaaggccctcgggttgtaaagcactttcagcgaggaagaaggcttggcggtcaatacccgtcaagaaggacatcactcgcagaagaagcaccggctaactccgtgccagcagccgcggtaatacggagggtgcgagcgttaatcggaattactgggcgtaaagcgcgcgtaggtggtttggcacgccggttgtgaaagccccgggctcaacctgggaacggcatccggaacggccagactagagtgcaggagaggaaggtagaattcccggtgtagcggtgaaatgcgtagagatcgggaggaataccagtggcgaaggcggccttctggcctgacactgacactgaggtgcgaaagcgtgggtagcaaacaggattagataccctggtagtccacgccgtaaacgatgtcgactagccgttgggacctttaaggacttagtggcgcagttaacgcgataagtcgaccgcctggggagtacggccgcaaggttaaaactcaaatgaattgacgggggcccgcacaagcggtggagcatgtggtttaattcgatgcaacgcgaagaaccttacctacccttgacatccagagaacttggtagagataccttggtgccttcgggaactctgagacaggtgctgcatggctgtcgtcagctcgtgttgtgaaatgttgggttaagtcccgtaacgagcgcaacccttgtccctatttgccagcgattcggtcgggaactctagggagactgccggtgacaaaccggaggaaggtggggacgacgtcaagtcatcatggcccttacgggtagggctacacacgtgctacaatggccggtacaaagggttgcgagaccgcgaggtggagcgaatcccagaaagccggcctcagtccggatcggagtctgcaactcgactccgtgaagtcggaatcgctagtaatcgtgaatcagaatgtcacggtgaatacgttcccgggccttgtacacaccgcccgtcacaccatgggagtggactgcaccagaagtggttagcttaaccctcgggggagcgatcaccacggtgtggttcatgactggggtgaagtcgtaacaaggtagccgtaggggaacctgcggctggatcacctccttaaac

SEQ ID NO: 8201 - DNA, 1552 bp, Salinisphaera halophila
  ref <308>: DATABASE ACCESSION NUMBER: NCBI ACCESSION: NZ_AYKF01000133.1
  ref <309>: DATABASE ENTRY DATE: 2019-04-01
  ref <313>: RELEVANT RESIDUES IN SEQ ID NO: (1)..(1552)
attaaactggagagtttgatcctggctcagattgaacgctggcggcaggcctaacacatgcaagtcgagcggcagcagcaggagcttgctcctggctggcgagcggcggacgggtgagtaatgcctaggaatctgcccttttgtggaggataacccggggaaactcgggctaatactgcataatctctacggagcaaagcggggctcttcgaccctcgcgcagaaggatgagcctaggtctgattagcttgttggtggggtaacggcctaccaaggcaacgatcagtagctggtctgagaggatgatcagccacaccgggactgagacacggcccggactcctacgggaggcagcagtggggaatattggacaatgggcgaaagcctgatccagccatgccgcgtgtgtgaagaaggccttagggttgtaaagcactttaagcaggaaagaaaagcgccgagttaatagctcgagcgtgttgacggtacctgcagaataagcaccggctaactccgtgccagcagccgcggtaatacggagggtgcaagcgttaatcggaattactgggcgtaaagcgagtgcaggcggttgcgtatgtcggatgtgaaagccccgggctcaacctgggaattgcattcgaaactgcgtaactagaatatggtagaggaagacggaattccacgtgtagcggtgaaatgcgtagatatgtggaggaacaccaatggcgaaggcagtcttctgggccaatattgacgctgaggctcgaaagcgtgggtagcaaacaggattagataccctggtagtccacgccgtaaacgatgagaactagacgttgggcgacatagtcgctcagtgtcgcagcaaacgcgttaagttctccgcctggggagtacggccgcaaggttgaaactcaaaggaattgacgggggcccgcacaagcggtggagcatgtggtttaattcgatgcaacgcgaagaaccttacctgcccttgacatcctgtgaacccttcggagacgaaggggtgctttcgagaacacagtgacaggtgctgcatggctgtcgtcagctcgtgtcgtgagatgttgggttaagtcccgcaacgagcgcaacccctatccttagttgccagcattaagttgggcactctaaggagactgccggtgacaaaccggaggaaggtggggatgacgtcaagtcatcatggcccttatgggcagggctacacacgtgctacaatggcaagtacaaagggttgctaagccgcgaggtggtgctaatctcataaagcttgtcttagtccggattgcagtctgcaactcgactgcatgaagtcggaatcgctagtaatcgcagatcagcaatgctgcggtgaatacgttcccgggccttgtacacaccgcccgtcacaccatggaagtcggttgcaccagaagaggctagtctaaccttcgggaggacggtctccacggtgtgatcgatgactggggtgaagtcgtaacaaggtagccgtaggggaacctgcggctggatcacctcctttcgagaatgc

SEQ ID NO: 8202 - DNA, 1561 bp, Salinisphaera japonica
  ref <308>: DATABASE ACCESSION NUMBER: NCBI ACCESSION: NZ_AYKG01000053.1
  ref <309>: DATABASE ENTRY DATE: 2019-04-01
  ref <313>: RELEVANT RESIDUES IN SEQ ID NO: (1)..(1561)
gttagatagtaagtatttaaactggagagtttgatcctggctcagattgaacgctggcggcaggcctaacacatgcaagtcgagcggaaacgacatcttcggatgggcgtcgagcggcggacgggtgagtaatgcgtagatatctgccttttagtggaggataacctggggaaactcaggctaatactgcataatctctacggagcaaagcggaggatcttcggacttcgcgctattagatgagtctacgtctgattagctagttggtgcggtaacggcgtaccaaggcgacgatcagtagctggtctgagaggatggtcagccacaccgggactgagacacggcccggactcctacgggaggcagcagtggggaatattggacaatgggcgaaagcctgatccagccatgccgcgtgtgtgaagaaggccttagggttgtaaagcactttaagcaggaaagaaaagcgccgggttaataccccgagcgtattgacggtacctgcagaataagcaccggctaactccgtgccagcagccgcggtaatacggagggtgcaagcgttaatcggaattactgggcgtaaagcgagtgcaggcggtcgcgtgtgtcgggtgtgaaagccccgggctcaacctgggaattgcatccgaaactgcgtgactagaatatggtagaggaagacggaattccacgtgtagcggtgaaatgcgtagatatgtggaggaacaccaatggcgaaggcagtcttctgggccaatattgacgctgaggctcgaaagcgtgggtagcaaacaggattagataccctggtagtccacgccgtaaacgctgagaactagacgttggatgacatagtcgttcagtgtcgcagctaacgcgttaagttctccgcctggggagtacggccgcaaggttgaaactcaaaggaattgacgggggcccgcacaagcggtggagcatgtggtttaattcgatgcaacgcgaagaaccttacctgcccttgacatcctgtgaacctcttggagacgagagggtgctttcgagaacacagtgacaggtgctgcatggctgtcgtcagctcgtgtcgtgagatgttgggttaagtcccgcaacgagcgcaacccctatccttagttgccagcattaagttgggcactctaaggagactgccggtgacaaaccggaggaaggtggggacgacgtcaagtcatcatggcccttatgggcagggctacacacgtgctacaatggcaagtacaaagggtatgcgaactcgcgagagggtgccaatcccataaagcttgtcccagtccggatcgcagtctgcaactcgactgcgtgaagtcggaatcgctagtaatcgcagatcagcaatgctgcggtgaatacgttcccgggccttgtacacaccgcccgtcacaccatggaagtcggctgcaccagaagtggctagtctaactcttcggagaggacggtcaccacggtgtggtcgatgactggggtgaagtcgtaacaaggtagccgtaggggaacctgcggctggatcacctcctttaga

SEQ ID NO: 8203 - DNA, 1552 bp, Salinisphaera orenii; identical to SEQ ID NO: 8201
  ref <308>: DATABASE ACCESSION NUMBER: NCBI ACCESSION: NZ_AYKH01000043.1
  ref <309>: DATABASE ENTRY DATE: 2019-04-01
  ref <313>: RELEVANT RESIDUES IN SEQ ID NO: (1)..(1552)

SEQ ID NO: 8204 - DNA, 1548 bp, Salinisphaera sp. LB1
  ref <308>: DATABASE ACCESSION NUMBER: NCBI ACCESSION: NZ_RAQL01000001.1
  ref <309>: DATABASE ENTRY DATE: 2019-04-01
  ref <313>: RELEVANT RESIDUES IN SEQ ID NO: (1)..(1548)
attaaactggagagtttgatcctggctcagattgaacgctggcggcaggcctaacacatgcaagtcgagcggtagcaggaggtgcttgcaccttgctgacgagcggcggacgggtgagtaaagcgtagatatctgccttttagtggaggacaacctggggaaactcaggctaatactgcataatctctacggagcaaagcggggctcttctaccctcgcgctaaaagatgagtctacgtctgattagctagttggtggggtaacggcctaccaaggcgacgatcagtagctggtctgagaggatgatcagccacaccgggactgagacacggcccggactcctacgggaggcagcagtggggaatattggacaatgggcgcaagcctgatccagccatgccgcgtgtgtgaagaaggccctagggttgtaaagcactttaagcaggaaagaaaagcgccggtttaatacaccgagcgtattgacggtacctgcagaataagcaccggctaactccgtgccagcagccgcggtaatacggagggtgcgagcgttaatcggaattactgggcgtaaagcgagtgcaggcggtcgcgtgtgtcgggtgtgaaagcccagggctcaaccttggaattgcactcgaaactgcgtgactagaatatggtagaggaagacggaattccacgtgtagcggtgaaatgcgtagatatgtggaggaacaccaatggcgaaggcagtcttctgggccaatattgacgctgaggctcgaaagcgtgggtagcaaacaggattagataccctggtagtccacgccgtaaacgatgagaactagacgttggttgacatagtcgaccagtgtcgcagctaacgcgttaagttctccgcctggggagtacggccgcaaggttgaaactcaaaggaattgacgggggcccgcacaagcggtggagcatgtggtttaattcgatgcaacgcgaagaaccttacctgcccttgacatcctgcgaaccctttggagacgaaggggtgccttcgggagcgcagtgacaggtgctgcatggctgtcgtcagctcgtgtcgtgagatgttgggttaagtcccgcaacgagcgcaacccctatccttagttgccagcattaagttgggcactctaaggagactgccggtgacaaaccggaggaaggtggggatgacgtcaagtcatcatggcccttatgggcagggctacacacgtgctacaatggcaagtacaaagggttgcgaacctgcgaaggggtgccaatcccataaagcttgtcccagtccggattgtagtctgcaactcgactacatgaagtcggaatcgctagtaatcgcagatcagcaatgctgcggtgaatacgttcccgggccttgtacacaccgcccgtcacaccatggaagtcggctgcaccagaagtggctagtctaactcttcggagaggacggtcaccacggtgtggtcgatgactggggtgaagtcgtaacaaggtagccgtaggggaacctgcggctggatcacctcctttaga

SEQ ID NO: 8205 - DNA, 1544 bp, Salinisphaera sp. Q1T1-3
  ref <308>: DATABASE ACCESSION NUMBER: NCBI ACCESSION: NZ_QZWD01000029.1
  ref <309>: DATABASE ENTRY DATE: 2019-04-01
  ref <313>: RELEVANT RESIDUES IN SEQ ID NO: (1)..(1544)
ttaaactggagagtttgatcctggctcagattgaacgctggcggcaggcctaacacatgcaagtcgagcggaaacgacatcttcggatgggcgtcgagcggcggacgggtgagtaacgcgtagatatctgccttttagtggaggataacccggggaaactcgggctaatactgcataatctctacggagcaaagcggaggatcttcggacttcgcgctgaaagatgagtctacgtctgattagctagttggtgcggtaatggcgtaccaaggcaacgatcagtagctggtctgagaggatgatcagccacaccgggactgagacacggcccggactcctacgggaggcagcagtggggaatattggacaatgggcgaaagcctgatccagccatgccgcgtgtgtgaagaaggccttagggttgtaaagcactttaagcaggaaagaaaagcgccgggttaataccccgagcgtcttgacggtacctgcagaataagcaccggctaactccgtgccagcagccgcggtaatacggagggtgcaagcgttaatcggaattactgggcgtaaagcgagtgcaggcggtcgcgtgtgtcgggtgtgaaagccccgggctcaacctgggaattgcattcgaaactgcgtgactagaatatggtagaggaagacggaattccacgtgtagcggtgaaatgcgtagatatgtggaggaacaccaatggcgaaggcagtcttctgggccaatattgacgctgaggctcgaaagcgtgggtagcaaacaggattagataccctggtagtccacgccgtaaacgctgagaactagacgttggctgacatagtcggccagtgtcgcagctaacgcgttaagttctccgcctggggagtacggccgcaaggttgaaactcaaaggaattgacgggggcccgcacaagcggtggagcatgtggtttaattcgatgcaacgcgaagaaccttacctgcccttgacatcctcggaacttggcagagatgccttggtgccttcgggaaccgagtgacaggtgctgcatggctgtcgtcagctcgtgtcgtgagatgttgggttaagtcccgcaacgagcgcaacccctatccttagttgccagcattcagttgggcactctaaggagactgccggtgacaaaccggaggaaggtggggacgacgtcaagtcatcatggcccttatgggcagggctacacacgtgctacaatggcaagtacaaagggttgcgaacctgcgaaggggtgccaatcccataaagcttgtcccagtccggattgcagtctgcaactcgactgcatgaagtcggaatcgctagtaatcgcagatcagcaatgctgcggtgaatacgttcccgggccttgtacacaccgcccgtcacaccatggaagtcggttgcaccagaagtggctagtctaactcttcggagaggacggtcaccacggtgtggtcgatgactggggtgaagtcgtaacaaggtagccgtaggggaacctgcggctggatcacctcctttaga

SEQ ID NO: 8206 - DNA, 1031 bp, Salinivibrio costicola
  ref <308>: DATABASE ACCESSION NUMBER: NCBI ACCESSION: NZ_LT897819.1
  ref <309>: DATABASE ENTRY DATE: 2019-04-01
  ref <313>: RELEVANT RESIDUES IN SEQ ID NO: (1)..(1031)
aaattgaagagtttgatcatggctcagattgaacgctggcggcaggcctaacacatgcaagtcgagcggaaacggcagcattgaagcttcggtggatttgctggacgtcgagcggcggacgggtgagtaacggctgggaacctgccctgacgcgggggataaccgttggaaacgacggctaataccgcataatgtcttagttcattacgagctgggaccaaaggtggcctctacatgtaagctatcgcgttgggatgggcccagttaggattagctagttggtaaggtaatggcttaccaaggcgacgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtggtgtacttaatacgtgcatggcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgctgtctacttggaggttgaggtttagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagcgaa

SEQ ID NO: 8207 - DNA, 946 bp, Salinivibrio kushneri
  ref <308>: DATABASE ACCESSION NUMBER: NCBI ACCESSION: NZ_MUEV01000061.1
  ref <309>: DATABASE ENTRY DATE: 2019-04-01
  ref <313>: RELEVANT RESIDUES IN SEQ ID NO: (1)..(946)
ggaccaaaggtggcctctacatgtaagctatcgcgttgggatgggcccagttaggattagctagttggtaaggtaatggcttaccaaggcgacgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtggtgtacttaataagtgcatggcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgctgtctacttggaggttgaggtttagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagcgaatcctttagagatagaggagtgccttcgggagcgctgagacaggtgctgcatggctgtcgtcagctcgtgttgtgaaatgttgggttaagtcccgcaacgagcgcaacccttatccttgtttgccagcac

SEQ ID NO: 8208 - DNA, 1755 bp, Salinivibrio proteolyticus
  misc_feature (1351)..(1351): n is a, c, g, or t
  ref <308>: DATABASE ACCESSION NUMBER: NCBI ACCESSION: NZ_MUFP01000007.1
  ref <309>: DATABASE ENTRY DATE: 2019-04-01
  ref <313>: RELEVANT RESIDUES IN SEQ ID NO: (1)..(1755)
ttaattgaagagtttgatcatggctcagattgaacgctggcggcaggcctaacacatgcaagtcgagcggaaacggcagtattgaagcttcggtggatttactggrcgtcgagcggcggacgggtgagtaayggctgggaacctgccctgacgagggggataaccgttggaaacgacggctaataccgcataatgtctacggaccaaaggtggcctctrcatgtaagctatcgcgttgggatgggcccagttaggattagctagttggtaaggtaayggcttaccaaggcgacgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtagtgtacttaatacgtgcattgcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgatgtctacttggaggctgaggttttagactttggctttcggagctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggarctctgagacaggtgctgcatggctgtcgtcagctcgtgttgtgaaatgttgggttaagtcccgcaacgagcgcaacccttatccttgtttgccagcacgtaaaggtgggaactccagggagactgccggtgataaaccggaggaaggtggggacgacgtcaagtcatcatggcccttacgagtagggctacacacgtgctacaatggcagatacagagggcagcgagacagcgatgttaagcgaatcccttaaagtttgtcgtagtccggattggagtctgcaactcgactccatgaagtcnggtgggaactccagggagactgccggtgataaaccggaggaaggtggggacgacgtcaagtcatcatggcccttacgagtagggctacacacgtgctacaatggcagatacagagggcagcgagacagcgatgttaagcgaatcccttaaagtttgtcgtagtccggattggagtctgcaactcgactccatgaagtcggaatcgctagtaatcgcagatcagaatgctgcggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctcctta

SEQ ID NO: 8209 - DNA, 1013 bp, Salinivibrio sharmensis
  ref <308>: DATABASE ACCESSION NUMBER: NCBI ACCESSION: NZ_MUFC01000007.1
  ref <309>: DATABASE ENTRY DATE: 2019-04-01
  ref <313>: RELEVANT RESIDUES IN SEQ ID NO: (1)..(1013)
aaattgaagagtttgatcatggctcagattgaacgctggcggcaggcctaacacatgcaagtcgagcggaaacggcagcattgaagcttcggtggatttgctggacgtcgagcggcggacgggtgagtaacggctgggaacctgccctgacgagggggataaccgttggaaacgacggctaataccgcataatgtctwcggaccaaaggtggcctctacatgtaagctatcgcgttgggatgggcccagttaggattagctagttggtaaggtaatggcttaccaaggcgacgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtggtgtacttaatacgtgcattgcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgctgtctacttggaggttgaggtttaagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccag

SEQ ID NO: 8210 - DNA, 1139 bp, Salinivibrio siamensis
  ref <308>: DATABASE ACCESSION NUMBER: NCBI ACCESSION: NZ_MUFB01000014.1
  ref <309>: DATABASE ENTRY DATE: 2019-04-01
  ref <313>: RELEVANT RESIDUES IN SEQ ID NO: (1)..(1139)
ttcagcggcggacgggtgagtaacggctgggaacctgccctgacgagggggataaccgttggaaacgacggctaataccgcataatgtctacggaccaaaggtggcctctacatgtaagctatcgcgttgggatgggcccagttaggattagctagttggtaaggtaatggcttaccaaggcgacgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtggtgtacttaatasgtgcayggcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgctgtctacttggaggttgaggtttagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggarckctgagacaggtgctgcatggctgtcgtcagctcgtgttgtggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctcctta

SEQ ID NO: 8211 - DNA, 1570 bp, Salinivibrio socompensis
  ref <308>: DATABASE ACCESSION NUMBER: NCBI ACCESSION: NZ_AQOE01000251.1
  ref <309>: DATABASE ENTRY DATE: 2019-04-01
  ref <313>: RELEVANT RESIDUES IN SEQ ID NO: (1)..(1570)
ttaattgaagagtttgatcatggctcagattgaacgctggcggcaggcctaacacatgcaagtcgagcggaaacggcagcattgaagcttcggtggatgtgctggacgtcaagcggcggacgggtgagtaacggctgggaacctgccctgacgagggggataaccgttggaaacgacggctaataccgcataatgtcttggttcgttaggatcaggaccaaaggtggcctctacatgtaagctatcgcgttgggatgggcccagttaggattagctagttggtaaggtaatggcttaccaaggcaacgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtcgtgtacttaataggtgcacggcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccctctggacaaagactgacgctcagatgcgaaagcgtgggtagcaaacaggattagataccctggtagtccacgctgtaaacgatgtctacttggaggttgaggttttagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagcgaagcctttagagatagaggcgtgccttcgggagcgctgagacaggtgctgcatggctgtcgtcagctcgtgttgtgaaatgttgggttaagtcccgcaacgagcgcaacccttatccttgtttgccagcacataatggtgggaactccagggagactgccggtgataaaccggaggaaggtggggacgacgtcaagtcatcatggcccttacgagtagggctacacacgtgctacaatggcagatacagagggcagcgagacagcgatgttgagcgaatcccttaaagtttgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctcctta

SEQ ID NO: 8212 - DNA, 1571 bp, Salinivibrio sp. AR640
  ref <308>: DATABASE ACCESSION NUMBER: NCBI ACCESSION: NZ_MUFD01000017.1
  ref <309>: DATABASE ENTRY DATE: 2019-04-01
  ref <313>: RELEVANT RESIDUES IN SEQ ID NO: (1)..(1571)
ttaattgaagagtttgatcatggctcagattgaacgctggcggcaggcctaacacatgcaagtcgagcggaaacggcagtattgaagcttcggtggatttactggacgtcgagcggcggacgggtgagtaacggctgggaacctgccctgacgagggggataaccgttggaaacgacggctaataccgcataatgtcttrrttcrttagagyyrggaccaaaggtggcctctacatgtaagctatcgcgttgggatgggcccagttaggattagctagttggtaaggtaatrgcttaccaaggcaacgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtygtgtacttaatasgtgcacrgcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgctgtctacttggaggttgaggttttagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagcgaagcctttagagatagaggygtgccttcgggagcgctgagacaggtgctgcatggctgtcgtcagctcgtgttgtgaaatgttgggttaagtcccgcaacgagcgcaacccttatccttgtttgccagcacrtaatggtgggaactccagggagactgccggtgataaaccggaggaaggtggggacgacgtcaagtcatcatggcccttacgagtagggctacacacgtgctacaatggcagatacagagggcagcgagacagcgatgtttagcgaatcccttaaagtttgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctccttac

SEQ ID NO: 8213 - DNA, 1570 bp, Salinivibrio sp. AR647
  ref <308>: DATABASE ACCESSION NUMBER: NCBI ACCESSION: NZ_MUFE01000001.1
  ref <309>: DATABASE ENTRY DATE: 2019-04-01
  ref <313>: RELEVANT RESIDUES IN SEQ ID NO: (1)..(1570)
ttaattgaagagtttgatcatggctcagattgaacgctggcggcaggcctaacacatgcaagtcgagcggaaacggcagtattgaagcttcggtggatttactggacgtcgagcggcggacgggtgagtaacggctgggaacctgccctgacgagggggataaccgttggaaacgacggctaataccgcataatgtcttgattcgttagagtcaggaccaaagrtggcctctacatgtaagctatcgcgttgggatgggcccagttaggattagctagttggtaaggtaatggcttaccaaggcaacgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtygtgtacttaatacgtgcacggcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgctgtctacttggaggttgaggttttagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagcgaagcctttagagatagaggygtgccttcgggagcgctgagacaggtgctgcatggctgtcgtcagctcgtgttgtgaaatgttgggttaagtcccgcaacgagcgcaacccttatccttgtttgccagcacrtaatggtgggaactccagggagactgccggtgataaaccggaggaaggtggggacgacgtcaagtcatcatggcccttacgagtagggctacacacgtgctacaatggcagatacagagggcagcgagacagcgatgtttagcgaatcccttaaagtttgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctcctta

SEQ ID NO: 8214 - DNA, 2166 bp, Salinivibrio sp. IB282
  misc_feature (1027)..(1027): n is a, c, g, or t
  misc_feature (1558)..(1558): n is a, c, g, or t
  misc_feature (2012)..(2012): n is a, c, g, or t
  ref <308>: DATABASE ACCESSION NUMBER: NCBI ACCESSION: NZ_MUET01000075.1
  ref <309>: DATABASE ENTRY DATE: 2019-04-01
  ref <313>: RELEVANT RESIDUES IN SEQ ID NO: (1)..(2166)
aattgaagagtttgatcatggctcagattgaacgctggcggcaggcctaacacatgcaagtcgagcggaaacggcagtattgaagcttcggtggatttactggacgtcgagcggcggacgggtgagtaacggctgggaacctgccctgacgagggggataaccgttggaaacgacggctaataccgcataatgtcttagttcattacgagctgggaccaaaggtggcctctacatgtaagctatcgcgttgggatgggcccagttaggattagctagttggtaaggtaatggcttaccaaggcracgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtggtgtacttaatamgtgcayggcttgacgttagctgcagaagaagcaccggctaactccgtgccagcagccgcggtaatacggagggtgcgagcgttaatcrgaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgctgtctacttggaggttgaggtttagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagngtccacgccgtaaacgctgtctacttggaggttgaggtttagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagcgaakcctttagagatagaggmgtgccttcgggagcgctgagacaggtgctgcatggctgtcgtcagctcgtgttgtgaaatgttgggttaagtcccgcaacgagcgcaacccttatccttgtttgccagcacrtaatggtgggaactccagggagactgccggtgataaaccggaggaaggtggggacgacgtcaagtcatcatggcccttacgagtagggctacacacgtgctacaatggcagatacagagggcagcgaagctgcgaagtggagcgaatcccttaaagtctgtcgtagtccggattggagtctgcaactcgactccatgantaatggtgggaactccagggagactgccggtgataaaccggaggaaggtggggacgacgtcaagtcatcatggcccttacgagtagggctacacacgtgctacaatggcagatacagagggcagcgaagctgcgaagtrgagcgaatcccttaaagtctgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctccttactgacgctattgttgcgagtgctcacacagattgtataggttgaanttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctccttac

SEQ ID NO: 8215 - DNA, 1555 bp, Salinivibrio sp. IB574
  ref <308>: DATABASE ACCESSION NUMBER: NCBI ACCESSION: NZ_MUFN01000011.1
  ref <309>: DATABASE ENTRY DATE: 2019-04-01
  ref <313>: RELEVANT RESIDUES IN SEQ ID NO: (1)..(1555)
taattgaagagtttgatcatggctcagattgaacgctggcggcaggcctaacacatgcaagtcgagcggaaacggcagtattgaagcttcggtggatttactggacgtcgagcggcggacgggtgagtaacggctgggaacctgccctgacgagggggataaccgttggaaacgacggctaataccgcataatgtctacggaccaaaggtggcctctacatgtaagctatcrcgtygggatgggcccagttaggattagctagttggtaaggtaayggcttaccaaggcgacgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtagtgtacttaatacgtgcattgcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgatgtctacttggaggctgaggtttaagactttggctttcggagctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagcgaatcctttagagatagaggagtgccttcgggagcgctgagacaggtgctgcatggctgtcgtcagctcgtgttgtgaaatgttgggttaagtcccgcaacgagcgcaacccttatccttgtttgccagcrmrtaatgkygggaactccagggagactgccggtgataaaccggaggaaggtggggacgacgtcaagtcatcatggcccttacgagtagggctacacacgtgctacaatggcrgatacagagggcagcgagacagcgatgttaagcgaatcccttaaagtttgtcgtagtccggattggagtctgcaactcgactccatgaagtcggaatcgctagtaatcgcagatcagaatgctgcggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctcctta

SEQ ID NO: 8216 - DNA, 1454 bp, Salinivibrio sp. IB643
  ref <308>: DATABASE ACCESSION NUMBER: NCBI ACCESSION: NZ_MUFF01000025.1
  ref <309>: DATABASE ENTRY DATE: 2019-04-01
  ref <313>: RELEVANT RESIDUES IN SEQ ID NO: (1)..(1454)
ttaattgaagagtttgatcatggctcagattgaacgctggcggcaggcctaacacatgcaagtcgagcggaaacggcagtattgaagcttcggtggatggaccaaaggtggcctctacatgtaagctatcgcgttgggatgggcccagttaggattagctagttggtaaggtaatggcttaccaaggcracgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtcgtgtacttaatacgtgcacggcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgctgtctacttggaggttgaggttttagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagcgaagcctttagagatagaggygtgccttcgggagcgctgagacaggtgctgcatggctgtcgtcagctcgtgttgtgaaatgttgggttaagtcccgcaacgagcgcaacccttatccttgtttgccagcacrtaatggtgggaactccagggagactgccggtgataaaccggaggaaggtggggacgacgtcaagtcatcatggcccttacgagtagggctacacacgtgctacaatggcagatacagagggcagcgagacagcgatgtttagcgaatcccttaaagtttgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctcctta

SEQ ID NO: 8217 - DNA, 1653 bp, Salinivibrio sp. IB868
  misc_feature (1249)..(1249): n is a, c, g, or t
  ref <308>: DATABASE ACCESSION NUMBER: NCBI ACCESSION: NZ_MUEW01000003.1
  ref <309>: DATABASE ENTRY DATE: 2019-04-01
  ref <313>: RELEVANT RESIDUES IN SEQ ID NO: (1)..(1653)
ctggacgtcgagcggcggacgggtgagtaacggctgggaacctgccctgacgagggggataaccgttggaaacgacggctaataccgcataatgtctacggaccaaaggtggcctctacatgtaagctatcgcgttgggatgggcccagttaggattagctagttggtaaggtaatggcttaccaaggcgacgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtggtgtacttaatamgtgcaykgcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgctgtctacttggaggttgaggtttagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggagckctgagacaggtgctgcatggctgtcgtcagctcgtgttgtgaaatgttgggttaagtcccgcaacgagcgcaacccttatccttgtttgccagcacgtaawggtgggaactccagggagactgccggtgataaaccggaggaaggtggggacgacgtcaagtcatcatggcccttacgagtagggctacacacgtgctacaatggcagatacagagggcagcgaagctgcgaagtggagcgaatcccttaaagtttgtcgtagtccggattggagtctgcaactcgactccatgaagtcnggtgggaactccagggagactgccggtgataaaccggaggaaggtggggacgacgtcaagtcatcatggcccttacgagtagggctacacacgtgctacaatggcagatacagagggcagcgaagctgcgaagtggagcgaatcccttaaagtttgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctcctta

SEQ ID NO: 8218 - DNA, 534 bp, Salinivibrio sp. IB870
  ref <308>: DATABASE ACCESSION NUMBER: NCBI ACCESSION: NZ_MUEX01000018.1
  ref <309>: DATABASE ENTRY DATE: 2019-04-01
  ref <313>: RELEVANT RESIDUES IN SEQ ID NO: (1)..(534)
gtccacgccgtaaacgctgtctacttggaggttgaggtttagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggagctctgagacaggtgctgcatggctgtcgtcagctcgtgttgtgaaatgttgggttaagtcccgcaacgagcgcaacccttatccttgtttgccagcacrtaawggtgggaactccagggagactgccggtgataaaccggaggaaggtggggacgacgtcaagtcatcatggcccttacgagtagggctacacacgtgctacaatggcagatacagagggcagcgaagctgcgaagtggagcgaatcccttaaagtttgtcgtagtccggattggagtctgcaactcgactccatgaagtc

SEQ ID NO: 8219 - DNA, 1345 bp, Salinivibrio sp. IB872
  ref <308>: DATABASE ACCESSION NUMBER: NCBI ACCESSION: NZ_MUFO01000069.1
  ref <309>: DATABASE ENTRY DATE: 2019-04-01
  ref <313>: RELEVANT RESIDUES IN SEQ ID NO: (1)..(1345)
ttaattgaagagtttgatcatggctcagattgaacgctggcggcaggcctaacacatgcaagtcgagcggaaacggcagtattgaagcttcggtggatttactggacgtcgagcggcggacgggtgagtaacggctgggaacctgccctgacgagggggataaccgttggaaacgacggctaataccgcataatgtctacggaccaaaggtggcctctacatgtaagctatcgcgttrggatgggcccagttaggattagctagttggtaaggtaacggcttaccaaggcgacgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtagtgtacttaatacgtgcattgcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgatgtctacttggaggctgaggtttaagactttggctttcggagctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagcgaatcctttagagatagaggagtgccttcgggagcgctgagacaggcgagacagcgatgttaagcgaatcccttaaagtttgtcgtagtccggattggagtctgcaactcgactccatgaagtcggaatcgctagtaatcgcagatcagaatgctgcggtgaatacgttcccgggccttgtacacaccgcccgtcacaccatgggagtgggctgcaccagaagtagatagcttaaccttcgggrgggcgtttaccacggtgtggttcatgactggggtgaagtcgtaacaaggtagccctaggggaacctggggctggatcacctcctta

SEQ ID NO: 8220 - DNA, 1571 bp, Salinivibrio sp. MA351
  ref <308>: DATABASE ACCESSION NUMBER: NCBI ACCESSION: NZ_MUFG01000005.1
  ref <309>: DATABASE ENTRY DATE: 2019-04-01
  ref <313>: RELEVANT RESIDUES IN SEQ ID NO: (1)..(1571)
ttaattgaagagtttgatcatggctcagattgaacgctggcggcaggcctaacacatgcaagtcgagcggaaacggcagtattgaagcttcggtggatttactggacgtcgagcggcggacgggtgagtaacggctgggaacctgccctgacgagggggataaccgttggaaacgacggctaataccgcataatgtcttrrttcrttagagyyrkgaccaaaggtggcctctacatgtaagctatcgcgttgggatgggcccagttaggattagctagttggtaaggtaatggcttaccaaggcaacgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtcgtgtacttaatacgtgcacggcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgctgtctacttggaggttgaggttttagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagcgaagcctttagagatagaggcgtgccttcgggagcgctgagacaggtgctgcatggctgtcgtcagctcgtgttgtgaaatgttgggttaagtcccgcaacgagcgcaacccttatccttgtttgccagcacrtaatggtgggaactccagggagactgccggtgataaaccggaggaaggtggggacgacgtcaagtcatcatggcccttacgagtagggctacacacgtgctacaatggcagatacagagggcagcgagacagcgatgtttagcgaatcccttaaagtttgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctccttac

SEQ ID NO: 8221 - DNA, 1571 bp, Salinivibrio sp. MA427
  ref <308>: DATABASE ACCESSION NUMBER: NCBI ACCESSION: NZ_MUFH01000040.1
  ref <309>: DATABASE ENTRY DATE: 2019-04-01
  ref <313>: RELEVANT RESIDUES IN SEQ ID NO: (1)..(1571)
ttaattgaagagtttgatcatggctcagattgaacgctggcggcaggcctaacacatgcaagtcgagcggaaacggcagtattgaagcttcggtggatttactggacgtcgagcggcggacgggtgagtaacggctgggaacctgccctgacgagggggataaccgttggaaacgacggctaataccgcataatgtcttrrttcgttagagyyrggaccaaaggtggcctctacatgtaagctatcgcgttgggatgggcccagttaggattagctagttggtaaggtaatggcttaccaaggcracgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtcgtgtasttaatacgtgcacggcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgctgtctacttggaggttgaggttttagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagcgaagcctttagagatagaggygtgccttcgggagcgctgagacaggtgctgcatggctgtcgtcagctcgtgttgtgaaatgttgggttaagtcccgcaacgagcgcaacccttatccttgtttgccagcacrtaatggtgggaactccagggagactgccggtgataaaccggaggaaggtggggacgacgtcaagtcatcatggcccttacgagtagggctacacacgtgctacaatggcagatacagagggcagcgagacagcgatgtttagcgaatcccttaaagtttgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctccttac

SEQ ID NO: 8222 - DNA, 1877 bp, Salinivibrio sp. MA440
  misc_feature (521)..(521): n is a, c, g, or t
  ref <308>: DATABASE ACCESSION NUMBER: NCBI ACCESSION: NZ_MUFI01000007.1
  ref <309>: DATABASE ENTRY DATE: 2019-04-01
  ref <313>: RELEVANT RESIDUES IN SEQ ID NO: (1)..(1877)
ttaattgaagagtttgatcatggctcagattgaacgctggcggcaggcctaacacatgcaagtcgagcggaaacggcagtattgaagcttcggtggatttactggactttaattgaagagtttgatcatggctcagattgaacgctggcggcaggcctaacacatgcaagtcgagcggaaacggcagtattgaagcttcggtggatttactggacgtcgagcggcggacgggtgagtaacggctgggaacctgccctgacgaggggrataaccgttggaaacgacggctaataccgcataatrtcttgattcgttagagtcaggaccaaaggtggcctctacatgtaagctatcgcgttgggatgggcccagttaggattagctagttggtaaggtaatggcttaccaaggcaacratccttagctggtttgagaggatgatcagccacactgggactgagacacggcccagactcctacgggaggcagcagtggggaatattgcacaatgggggagaccnggaccaaaggtggcctctacatgtaagctatcgcgttgggatgggcccagttaggattagctagttggtaaggtaatggcttaccaaggcaacgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtcgtgtacttaatacgtgcacggcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgctgtctacttggaggttgaggttttagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagcgaagcctttagagatagaggygtgccttcgggagcgctgagacaggtgctgcatggctgtcgtcagctcgtgttgtgaaatgttgggttaagtcccgcaacgagcgcaacccttatccttgtttgccagcacrtaatggtgggaactccagggagactgccggtgataaaccggaggaaggtggggacgacgtcaagtcatcatggcccttacgagtagggctacacacgtgctacaatggcagatacagagggcagcgagacagcgatgtttagcgaatcccttaaagtttgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctcctta

SEQ ID NO: 8223 - DNA, 1571 bp, Salinivibrio sp. MA607
  ref <308>: DATABASE ACCESSION NUMBER: NCBI ACCESSION: NZ_MUFJ01000008.1
  ref <309>: DATABASE ENTRY DATE: 2019-04-01
  ref <313>: RELEVANT RESIDUES IN SEQ ID NO: (1)..(1571)
ttaattgaagagtttgatcatggctcagattgaacgctggcggcaggcctaacacatgcaagtcgagcggaaacggcagtattgaagcttcggtggatttactggacgtcgagcggcggacgggtgagtaacggctgggaacctgccctgacgagggggataaccgttggaaacgacggctaataccgcataatgtcttrrttcrttagagyyrggaccaaaggtggcctctacatgtaagctatcgcgttgggatgggcccagttaggattagctagttggtaaggtaatggcttaccaaggcaacgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtygtgtacttaatacgtgcacggcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgctgtctacttggaggttgaggttttagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagcgaagcctttagagatagaggygtgccttcgggagcgctgagacaggtgctgcatggctgtcgtcagctcgtgttgtgaaatgttgggttaagtcccgcaacgagcgcaacccttatccttgtttgccagcacrtaatggtgggaactccagggagactgccggtgataaaccggaggaaggtggggacgacgtcaagtcatcatggcccttacgagtagggctacacacgtgctacaatggcagatacagagggcagcgagacagcgatgtttagcgaatcccttaaagtttgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctccttac

SEQ ID NO: 8224 - DNA, 913 bp, Salinivibrio sp. ML198
  ref <308>: DATABASE ACCESSION NUMBER: NCBI ACCESSION: NZ_MUEZ01000046.1
  ref <309>: DATABASE ENTRY DATE: 2019-04-01
  ref <313>: RELEVANT RESIDUES IN SEQ ID NO: (1)..(913)
ctggacgtcgagcggcggacgggtgagtaacggctgggaacctgccctgacgagggggataaccgttggaaacgacggctaataccgcataatgtctacggaccaaaggtggcctctacatgtaagctatcgcgttgggatgggcccagttaggattagctagttggtaaggtaatggcttaccaaggcgacgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtggtgtacttaataggtgcatggcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgctgtctacttggaggttgaggtttaagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccag

SEQ ID NO: 8225 - DNA, 1351 bp, Salinivibrio sp. ML290
  ref <308>: DATABASE ACCESSION NUMBER: NCBI ACCESSION: NZ_MUEY01000001.1
  ref <309>: DATABASE ENTRY DATE: 2019-04-01
  ref <313>: RELEVANT RESIDUES IN SEQ ID NO: (1)..(1351)
ggtggatttactggacgtcgagcggcggacgggtgagtaacggctgggaacctgccctgacgagggggatggtggatttactggacgtcgagcggcggacgggtgagtaacggctgggaacctgccctgacgagggggataaccgttggaaacgacggctaataccgcataatgtctacggaccaaaggtggcctctacatgtaagctatcgcgttgggatgggcccagttaggattagctagttggtaaggtaatggcttaccaaggcgacgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtggtgtacttaatargtgcatggcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgctgtctacttggaggttgaggtttagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggarctctgagacaggtgctgcatggctgtcgtcagctcgtgttgtgaaatgttgggttaagtcccgcaacgagcgcaacccttatccttgtttgccagcacgtaaaggtgggaactccagggagactgccggtgataaaccggaggaaggtggggacgacgtcaagtcatcatggcccttacgagtagggctacacacgtgctacaatggcagatacagagggcagcgaagctgcgaagtggagcgaatcccttaaagtttgtcgtagtccggattggagtctgcaactcgactccatgaagtcggaatcgctagtaatcgggaacc

SEQ ID NO: 8226 - DNA, 1965 bp, Salinivibrio sp. ML323
  ref <308>: DATABASE ACCESSION NUMBER: NCBI ACCESSION: NZ_MUES01000039.1
  ref <309>: DATABASE ENTRY DATE: 2019-04-01
  ref <313>: RELEVANT RESIDUES IN SEQ ID NO: (1)..(1965)
aattgaagagtttgatcatggctcagattgaacgctggcggcaggcctaacacatgcaagtcgagcggaaacggcagyattgaagcttcggtggatttrctggacgtcgagcggcggacgggtgagtaacggctgggaacctgccctgacgagggggataaccgttggaaacgacggctaataccgcataatgtcttgrytcgttagagtcaggaccaaaggtggcctctacatgtaagctatcgcgttgggatgggcccagttaggattagctagttggtaaggtaatggcttaccaaggcracgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtggtgtacttaatamgtgcayggcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgctgtctacttggaggttgaggtttagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagagtccacgccgtaaacgctgtctacttggaggttgaggtttagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagwgaactttccagagatggattggtgccttcgggaacactgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctgctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcagatacagagggcagcgamgctgcgaagtrgagcgaatcccttaaagtytgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctcctta

SEQ ID NO: 8227 - DNA, 2081 bp, Salinivibrio sp. PR5
  misc_feature (943)..(943): n is a, c, g, or t
  misc_feature (1377)..(1377): n is a, c, g, or t
  misc_feature (1796)..(1796): n is a, c, g, or t
  ref <308>: DATABASE ACCESSION NUMBER: NCBI ACCESSION: NZ_MUFK01000001.1
  ref <309>: DATABASE ENTRY DATE: 2019-04-01
  ref <313>: RELEVANT RESIDUES IN SEQ ID NO: (1)..(2081)
aattgaagagtttgatcatggctcagattgaacgctggcggcaggcctaacacatgcaagtcgagcggaaacggcagtattgaagcttcggtggatttactggacgtcgagcggcggacgggtgagtaacggctgggaacctgccctgacgagggggataaccgttggaaacgacggctaataccgcactagttggtaaggtaayggcttaccaaggcgacgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtagtgtacttaatacgtgcattgcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgatgtctacttggaggctgaggtttaagactttggctttcggagctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagntccacgccgtaaacgatgtctacttggaggctgaggtttaagactttggctttcggagctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagcgaatcctttagagatagaggagtgccttcgggaackctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctnctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcagatacagagggcagcgagacagcgatgttaagcgaatcccttaaagtttgtcgtagtccggattggagtctgcaactcgactccatgaagtcggaatcgctagtaatcgcagatcagaatgctgcggtgaatacgttcccgggccttgtacacaccgcccgtcacaccatgggagtgggctgcaccagaagtagatagcttaaccttcgggngcgagacagcgatgttaagcgaatcccttaaagtttgtcgtagtccggattggagtctgcaactcgactccatgaagtcggaatcgctagtaatcgcagatcagaatgctgcggtgaatacgttcccgggccttgtacacaccgcccgtcacaccatgggagtgggctgcaccagaagtagatagcttaaccttcgggrgggcgtttaccacggtgtggttcatgactggggtgaagtcgtaacaaggtagccctaggggaacctggggctggatcacctcctta

SEQ ID NO: 8228 - DNA, 1754 bp, Salinivibrio sp. PR6
  misc_feature (1350)..(1350): n is a, c, g, or t
  ref <308>: DATABASE ACCESSION NUMBER: NCBI ACCESSION: NZ_MUFA01000006.1
  ref <309>: DATABASE ENTRY DATE: 2019-04-01
  ref <313>: RELEVANT RESIDUES IN SEQ ID NO: (1)..(1754)
aaattgaagagtttgatcatggctcagattgaacgctggcggcaggcctaacacatgcaagtcgagcggaaacggcagtattgaagcttcggtggatttactggacgtcgagcggcggacgggtgagtaacggctgggaacctgccctgacgagggggataaccgttggaaacgacggctaataccgcataatgtctacggaccaaaggtggcctctacatgtaagctatcgcgttgggatgggcccagttaggattagctagttggtaaggtaatggcttaccaaggcgacgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtggtgtacttaatasgtgcayggcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgctgtctacttggaggttgaggtttaagactttggctttcggcgctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggagctctgagacaggtgctgcatggctgtcgtcagctcgtgttgtgaaatgttgggttaagtcccgcaacgagcgcaacccttatccttgtttgccagcacataatggtgggaactccagggagactgccggtgataaaccggaggaaggtggggacgacgtcaagtcatcatggcccttacgagtagggctacacacgtgctacaatggcagatacagagggcagcgaagctgcgaagtggagcgaatcccttaaagtttgtcgtagtccggattggagtctgcaactcgactccatgaagtcnggtgggaactccagggagactgccggtgataaaccggaggaaggtggggacgacgtcaagtcatcatggcccttacgagtagggctacacacgtgctacaatggcagatacagagggcagcgaagctgcgaagtggagcgaatcccttaaagtttgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctcctta

SEQ ID NO: 8229 - DNA, 980 bp, Salinivibrio sp. PR919
  ref <308>: DATABASE ACCESSION NUMBER: NCBI ACCESSION: NZ_MUFL01000133.1
  ref <309>: DATABASE ENTRY DATE: 2019-04-01
  ref <313>: RELEVANT RESIDUES IN SEQ ID NO: (1)..(980)
gttggcggcaggcctaacacatgcaagtcgagcggaaacggcagtattgaagcttcggtggatttactggacgtcgagcggcggacgggtgagtaacggctgggaacctgccctracgagggggataaccgttggaaacgacggctaataccgcataatgtctacggaccaaaggtggcctctacatgtaagctatcgcgttgggatgggcccagttaggattagctagttggtaaggtaacggcttaccaaggcgacgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtagtgtacttaatacgtgcattgcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgatgtctacttggaggctgaggtttaagactttggctttcggagctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccaga

SEQ ID NO: 8230 - DNA, 908 bp, Salinivibrio sp. PR932
  ref <308>: DATABASE ACCESSION NUMBER: NCBI ACCESSION: NZ_MUFM01000059.1
  ref <309>: DATABASE ENTRY DATE: 2019-04-01
  ref <313>: RELEVANT RESIDUES IN SEQ ID NO: (1)..(908)
aattgaagagtttgatcatggctcagattgaacgctggcggcaggcctaacacatgcaagtcgagcggaaacggcagtattgaagcttcggtggatttactggacgtcgagcggcggacgggtgagtaacggctgggaacctgccctracgagggggataaccgttggaaacgacggctaataccgcaatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtagtgtacttaatacgtgcattgcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgatgtctacttggaggctgaggtttaagactttggctttcggagctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccag

SEQ ID NO: 8231 - DNA, 1557 bp, Salinivibrio sp. YCSC6
  ref <308>: DATABASE ACCESSION NUMBER: NCBI ACCESSION: NZ_NHNL01000001.1
  ref <309>: DATABASE ENTRY DATE: 2019-04-01
  ref <313>: RELEVANT RESIDUES IN SEQ ID NO: (1)..(1557)
taattgaagagtttgatcatggctcagattgaacgctggcggcaggcctaacacatgcaagtcgagcggaaacggcagtattgaagcttcggtggatttactggacgtcgagcggcggacgggtgagtaacggctgggaacctgccctgacgagggggataaccgttggaaacgacggctaataccgcataatgtctacggaccaaaggtggcctctacatgtaagctatcgcgttgggatgggcccagttaggattagctagttggtaaggtaatggcttaccaaggcgacgatccttagctggtttgagaggatgatcagccacactgggactgagacacggcccagactcctacgggaggcagcagtggggaatattgcacaatgggggagaccctgatgcagccatgccgcgtgtgtgaagaaggccttcgggttgtaaagcactttcagcagtgaggaaggtagtgtacttaatacgtgcattgcttgacgttagctgcagaagaagcaccggctaactccgtgccagcagccgcggtaatacggagggtgcgagcgttaatcggaattactgggcgtaaagcgcatgcaggcggtttgttaagtcagatgtgaaagcccggggctcaacctcggaaccgcatttgaaactggcaggctagagtcttgtagaggggggtagaatttcaggtgtagcggtgaaatgcgtagagatctgaaggaataccagtggcgaaggcggccccctggacaaagactgacgctcagatgcgaaagcgtgggtagcaaacaggattagataccctggtagtccacgccgtaaacgatgtctacttggaggctgaggtttaagactttggctttcggagctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccagcgaatcctttagagatagaggagtgccttcgggagcgctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcagatacagagggcagcgagacagcgatgttaagcgaatcccttaaagtttgtcgtagtccggattggagtctgcaactcgactccatgaagtcggaatcgctagtaatcgcagatcagaatgctgcggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctccttact

SEQ ID NO: 8232 - DNA, 1570 bp, Salipaludibacillus agaradhaerens
  ref <308>: DATABASE ACCESSION NUMBER: NCBI ACCESSION: NZ_KV917378.1
  ref <309>: DATABASE ENTRY DATE: 2019-04-01
  ref <313>: RELEVANT RESIDUES IN SEQ ID NO: (1)..(1570)
tatcggagagtttgatcctggctcaggacgaacgctggcggcgtgcctaatacatgcaagtcgagcgcaggaagccggcggatcccttcggggtgaagccggtggaatgagcggcggacgggtgagtaacacgtgggcaacctaccttgtagactgggataactccgggaaaccggggctaataccggatgatcatttggatcgcatgatccgaatgtaaaagtggggatttatcctcacactgcaagatgggcccgcggcgcattagctagttggtaaggtaatggcttaccaaggcgacgatgcgtagccgacctgagagggtgatcggccacactggaactgagacacggtccagactcctacgggaggcagcagtagggaatcatccgcaatgggcgaaagcctgacggtgcaacgccgcgtgaacgatgaaggttttcggatcgtaaagttctgttatgagggaagaacaagtgccgttcgaataggtcggcaccttgacggtacctcacgagaaagccccggctaactacgtgccagcagccgcggtaatacgtagggggcaagcgttgtccggaattattgggcgtaaagcgcgcgcaggcggtctcttaagtctgatgtgaaagcccacggctcaaccgtggagggtcattggaaactgggggacttgagtgtaggagaggaaagtggaattccacgtgtagcggtgaaatgcgtagatatgtggaggaacaccagtggcgaaggcgactttctggcctacaactgacgctgaggcgcgaaagcgtggggagcaaacaggattagataccctggtagtccacgccgtaaacgatgagtgctaggtgttaggggtttcgatacccttagtgccgaagttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctctgacacctctggagacagagcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgataaaccggaggaaggtggggatgacgtcaaatcatcatgccccttatgacctgggctacacacgtgctacaatggatggtacaaagggcagcgagaccgcgaggttaagcgaatcccataaagccattctcagttcggattgcaggctgcaactcgcctgcatgaagccggaattgctagtaatcgcggatcagcatgccgcggtgaatacgttcccgggccttgtacacaccgcccgtcacaccacgagagtttgtaacacccgaagtcggtgcggtaaccttttggagccagccgccgaaggtgggacagatgattggggtgaagtcgtaacaaggtatccctaccggaaggtggggatggatcacctcctttctaa

SEQ ID NO: 8233 - DNA, 1573 bp, Salipaludibacillus aurantiacus
  ref <308>: DATABASE ACCESSION NUMBER: NCBI ACCESSION: NZ_FOGT01000034.1
  ref <309>: DATABASE ENTRY DATE: 2019-04-01
  ref <313>: RELEVANT RESIDUES IN SEQ ID NO: (1)..(1573)
tttatggagagtttgatcctggctcaggacgaacgctggcggcgtgcctaatacatgcaagtcgagcgcaggaagcaagctgatcccttcggggtgacgcttgtggaatgagcggcggacgggtgagtaacacgtgggcaacctgccttgcagactgggataaccccgggaaaccggggctaataccggatgaccatccggatcgcatgatccgggtgtaaaagtggggaatttattcctcacactgcaagatgggcccgcggcgcattagctagttggtaaggtaacggcttaccaaggcgacgatgcgtagccgacctgagagggtgatcggccacactgggactgagacacggcccagactcctacgggaggcagcagtagggaatcatccgcaatgggcgaaagcctgacggtgcaacgccgcgtgaacgatgaaggttttcggatcgtaaagttctgttatgagggaagaacaagtgccggtcgaacaggccggcgccttgacggtacctcacgagaaagccccggctaactacgtgccagcagccgcggtaatacgtagggggcaagcgttgtccggaattattgggcgtaaagcgcgcgcaggcggtctcttaagtctgatgtgaaagcccacggctcaaccgtggagggtcattggaaactgggagacttgagtgtaggagaggaaagtggaattccacgtgtagcggtgaaatgcgtagatatgtggaggaacaccagtggcgaaggcgactttctggcctacaactgacgctgaggcgcgaaagcgtggggagcaaacaggattagataccctggtagtccacgccgtaaacgttgagtgctaggtgttaggggtttcgatgcccttagtgccgaagttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctctgaccaccctggagacagggctttccccttcgggggacagagtgacaggtggtgcatggttgtcgtcagctcgtgtcgtgagatgttgggttaagtcccgcaacgagcgcaacccttaatcttagttgccagcattcagttgggcactctaaggtgactgccggtgacaaaccggaggaaggtggggacgacgtcaaatcatcatgccccttatgacctgggctacacacgtgctacaatggatggtacaaagggcagcgagaccgcgaggttaagcgaatcccataaagccattctcagttcggattgcaggctgcaactcgcctgcatgaagccggaattgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtatccgtaccggaaggtgcggatggatcacctcctttctaa

SEQ ID NO: 8234 - DNA, 1572 bp, Salipaludibacillus neizhouensis
  ref <308>: DATABASE ACCESSION NUMBER: NCBI ACCESSION: NZ_PDOE01000064.1
  ref <309>: DATABASE ENTRY DATE: 2019-04-01
  ref <313>: RELEVANT RESIDUES IN SEQ ID NO: (1)..(1572)
tttatcggagagtttgatcctggctcaggacgaacgctggcggcgtgcctaatacatgcaagtcgagcgcaggaaacaagttgatcccttcggggtgacgcttgtggaatgagcggcggacgggtgagtaacacgtgggcaacctgccttgtagactgggataactccgggaaaccggagctaataccggatgaccaacggaatcgcatgattctgttgtaaaagtggggatttatcctcacactacgagatgggcccgcggcgcattagctagttggtaaggtaatggcttaccaaggcaacgatgcgtagccgacctgagagggtgatcggccacactggaactgagacacggtccagactcctacgggaggcagcagtagggaatcatccgcaatgggcgaaagcctgacggtgcaacgccgcgtgaacgatgaaggttttcggatcgtaaagttctgttatgagggaagaacaagtgccgttcgaatagggcggcaccttgacggtacctcacgagaaagccccggctaactacgtgccagcagccgcggtaatacgtagggggcaagcgttgtccggaattattgggcgtaaagcgcgcgcaggcggtctcttaagtctgatgtgaaagcccacggctcaaccgtggagggtcattggaaactgggggacttgagtgtaggagaggaaagtggaattccacgtgtagcggtgaaatgcgtagatatgtggaggaacaccagtggcgaaggcgactttctggcctataactgacgctgaggtgcgaaagcgtggggagcaaacaggattagataccctggtagtccacgccgtaaacgatgagtgctaggtgttaggggtttcgatgcccttagtgccgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctctgaccacccaagagattgggatttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgataaaccggaggaaggtggggatgacgtcaaatcatcatgccccttatgacctgggctacacacgtgctacaatggatggtacaaagggctgcaagaccgcgaggtcaagcgaatcccataaagccattctcagttcggattgcaggctgcaactcgcctgcatgaagccggaattgctagtaatcgcggatcagcatgccgcggtgaatacgttcccgggccttgtacacaccgcccgtcacaccacgagagtttgtaacacccgaagtcggtgaggtaacctttttggagccagccgccgaaggtgggacagatgattggggtgaagtcgtaacaaggtatccctaccggaaggtggggatggatcacctcctttcta

SEQ ID NO: 8235 - DNA, 1573 bp, Salipaludibacillus sp. KQ-12
  ref <308>: DATABASE ACCESSION NUMBER: NCBI ACCESSION: NZ_PDOD01000011.1
  ref <309>: DATABASE ENTRY DATE: 2019-04-01
  ref <313>: RELEVANT RESIDUES IN SEQ ID NO: (1)..(1573)
tttatcggagagtttgatcctggctcaggacgaacgctggcggcgtgcctaatacatgcaagtcgagcgcaggaagcaagcggatcccttcggggtgaagcttgtggaatgagcggcggacgggtgagtatcacgtgggcaacctgccttgcagactgggataactccgggaaaccggggctaataccggatgaccatttggatcgcatgatccggatgtaaaagtggggaatttattcctcacactgcgagatgggcccgcggcgcattagctagttggtaaggtaatggcttaccaaggcaacgatgcgtagccgacctgagagggtgatcggccacactggaactgagacacggtccagactcctacgggaggcagcagtagggaatcatccgcaatgggcgaaagcctgacggtgcaacgccgcgtgaacgatgaaggttttcggatcgtaaagttctgttatgagggaagaacaagtgccggtcaaataggccggcaccttgacggtacctcacgagaaagccccggctaactacgtgccagcagccgcggtaatacgtagggggcaagcgttgtccggaattattgggcgtaaagcgcgcgcaggcggtctcttaagtctgatgtgaaagcccacggctcaaccgtggagggtcattggaaactgggagacttgagtgtaggagaggaaagtggaattccacgtgtagcggtgaaatgcgtagatatgtggaggaacaccagtggcgaaggcgactttctggcctacaactgacgctgaggtgcgaaagcgtggggagcaaacaggattagataccctggtagtccacgccgtaaacgatgagtgctaggtgttaggggtttcgatgcccttagtgccgaagttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctctgaacatctaggagactaggttttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgataaaccggaggaaggtggggacgacgtcaaatcatcatgccccttatgacctgggctacacacgtgctacaatggatggtacaaagggcagcaagaccgcgaggtcaagcgaatcccataaagccattctcagttcggattgcaggctgcaactcgcctgcatgaagccggaattgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtatccctaccggaaggtggggatggatcacctcctttcta

SEQ ID NO: 8236 - DNA, 1467 bp, Salipiger aestuarii
  ref <308>: DATABASE ACCESSION NUMBER: NCBI ACCESSION: NZ_QLMG01000112.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcaccttcgggtgagcggcggacgggtgagtaacgcgtgggaatatgcccttctgtgcggaatagcctcgggaaactgagagtaataccgcatacgcccttcgggggaaagatttatcgcagaaggattagcccgcgttggattaggtagttggtggggtaatggcctaccaagcctacgatccatagctggtttgagaggatgatcagccacactgggactgagacacggcccagactcctacgggaggcagcagtggggaatcttagacaatgggcgcaagcctgatctagccatgccgcgtgagtgatgaaggccttagggtcgtaaagctctttcgctggggaagataatgactgtacccagtaaagaaaccccggctaactccgtgccagcagccgcggtaatacggagggggttagcgttgttcggaattactgggcgtaaagcgcgcgtaggcggactggaaagttgggggtgaaatcccggggctcaacctcggaactgccttcaaaactcccagtcttgagttcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccctggaccgctggagagattcagctttctcgtaagagaccaggtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcatcaacaatgggttaatcccaaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgccaacctttcgagggggcagcggaccacggtgagctcagcgactggggtgaagtcgtaacaaggtagccgtaggggaacctgcggctggatcacctcctttctaa

SEQ ID NO: 8237 - DNA, 1469 bp, Salipiger bermudensis
  ref <308>: DATABASE ACCESSION NUMBER: NCBI ACCESSION: NZ_DS022279.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgagaccttcgggtctagcggcggacgggtgagtaacgcgtgggaacgtacccttttctgcaggatagccactggaaacggtgagtaatactgcatacgcccttcgggggaaagatttatcggagaaggatcggcccgcgttagattaggtagttggtggggtaatggcctaccaagcctacgatctatagctggtttgagaggatgatcagccacactgggactgagacacggcccagactcctacgggaggcagcagtggggaatcttagacaatgggggcaaccctgatctagccatgccgcgtgagtgatgaaggccttagggtcgtaaagctctttcgctggggaagataatgacggtacccagtaaagaaaccccggctaactccgtgccagcagccgcggtaatacggagggggttagcgttgttcggaattactgggcgtaaagcgcgcgtaggcggatcagaaagttgggggtgaaatcccggggctcaacctcggaactgcctccaaaactcctggtcttgagttcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcagctacatccagagatggatggttcccttcggggactgagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcatctacagtgggttaatcccaaaaagatgtctcagttcggattgtcgtctgcaactcgacggcatgaagtcggaatcgctagtaatcgcgtaacagcatgacgcggtgaatacgttcccgggccttgtacacaccgcccgtcacaccatgggagttgggttcacccgaaggccgtgcgccaacctttcgaggaggcagcggaccacggtgagctcagcgactggggtgaagtcgtaacaaggtagccgtaggggaacctgcggctggatcacctcctttctaa

SEQ ID NO: 8238 - DNA, 1386 bp, Salipiger marinus
  ref <308>: DATABASE ACCESSION NUMBER: NCBI ACCESSION: NZ_FNEJ01000096.1
  ref <309>: DATABASE ENTRY DATE: 2019-04-01
  ref <313>: RELEVANT RESIDUES IN SEQ ID NO: (1)..(1386)
agcggcggacgggtgagtaacgcgtgggaacgtacccttctctgcggaatagccactggaaacggtgagtaataccgcatacgcccttcgggggaaagatttatcggagaaggatcggcccgcgttggattaggtagttggtggggtaatggcctaccaagcctacgatccatagctggtttgagaggatgatcagccacactgggactgagacacggcccagactcctacgggaggcagcagtggggaatcttagacaatgggcgcaagcctgatctagccatgccgcgtgagtgaagaaggccttagggtcgtaaagctctttcgctggggaagataatgactgtacccagtaaagaaaccccggctaactccgtgccagcagccgcggtaatacggagggggttagcgttgttcggaattactgggcgtaaagcgcgcgtaggcggatcagaaagttgggggtgaaatcccggggctcaacctcggaactgcctccaaaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccctggaccgccggagagatccggctttctcgcaagagaccaggtgacaggtgctgcatggctgtcgtcagctcgtgtcgtgagatgttcggttaagtccggcaacgagcgcaacccacatcttcagttgccagcagttcggctgggcactctggagaaactgcccgtgataagcgggaggaaggtgtggatgacgtcaagtcctcatggcccttacgggttgggctacacacgtgctacaatggcagtgacaatgggttaatcccaaaaaactgtctcagttcggattgtcgtctgcaactcgacggcatgaagtcggaatcgctagtaatcgcgtaacagcatgacgcggtgaatacgttcccgggccttgtacacaccgcccgtcacaccatgggagttgggttcacccgaaggccgtgcgccaacctttcgagggggcagcggaccacggtgagctcagcgactggggtgaagtcgtaacaaggtagccgtaggggaacctgcggctggatcacctcctttctaa

SEQ ID NO: 8239 - DNA, 1469 bp, Salipiger mucosus
  ref <308>: DATABASE ACCESSION NUMBER: NCBI ACCESSION: NZ_KE557279.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcctaacacatgcaagtcgagcgaggactccggtcctagcggcggacgggtgagtaacgcgtgggaacgtgcccttcactgcggaatagtccctggaaacggggtttaataccgcatacgcccttcgggggaaagaatttcggtgaaggatcggcccgcgttagattaggtagttggtggggtaacggcctaccaagcctacgatctatagctggtttgagaggatgatcagccacactgggactgagacacggcccagactcctacgggaggcagcagtggggaatcttagacaatgggggcaaccctgatctagccatgccgcgtgagtgatgaaggccctagggtcgtaaagctctttcgccagggaagataatgacggtacctggtaaagaaaccccggctaactccgtgccagcagccgcggtaatacggagggggttagcgttgttcggaattactgggcgtaaagcgcgcgtaggcggactggaaagttgggggtgaaatcccggggctcaacctcggaactgcctccaaaactcccagtcttgagttcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagtcgtcgggcagcatgctgttcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcctcagcgacatccggagacggatggttcccttcggggactgagtgacaggtgctgcatggctgtcgtcagctcgtgtcgtgagatgttcggttaagtccggcaacgagcgcaacccacacccttagttgccagcagttcggctgggcactctaggggaactgcccgtgataagcgggaggaaggtgtggatgacgtcaagtcctcatggcccttacgggttgggctacacacgtgctacaatggtatctacagtgggttaatccccaaaagatatctcagttcggattgtcgtctgcaactcgacggcatgaagtcggaatcgctagtaatcgcgtaacagcatgacgcggtgaatacgttcccgggccttgtacacaccgcccgtcacaccatgggagttgggttcacccgaaggccgtgcgccaacctgttcgcagggggcagcggaccacggtgagctcagcgactggggtgaagtcgtaacaaggtagccgtaggggaacctgcggctggatcacctcctttctaa

SEQ ID NO: 8240 - DNA, 1466 bp, Salipiger profundus
  ref <308>: DATABASE ACCESSION NUMBER: NCBI ACCESSION: NZ_FOLR01000044.1
  ref <309>: DATABASE ENTRY DATE: 2019-04-01
  ref <313>: RELEVANT RESIDUES IN SEQ ID NO: (1)..(1466)
caacttgagagtttgatcctggctcagaacgaacgctggcggcaggcctaacacatgcaagtcgagcgaagccttcgggcttagcggcggacgggtgagtaacgcgtgggaacgtgcccttcactacggaatagtcccgggaaactgggtttaataccgtatacgcccttcgggggaaagaatttcggtgaaggatcggcccgcgttagattaggtagttggtggggtaatggcctaccaagcctacgatctatagctggtttgagaggatgatcagccacactgggactgagacacggcccagactcctacgggaggcagcagtggggaatcttagacaatgggggcaaccctgatctagccatgccgcgtgagtgatgaaggccttagggtcgtaaagctctttcgctggggaagataatgacggtacccagtaaagaaaccccggctaactccgtgccagcagccgcggtaatacggagggggttagcgttgttcggaattactgggcgtaaagcgcgcgtaggcggactggaaagttgggggtgaaatcccggggctcaacctcggaactgcctccaaaactatcagtctagagttcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccacccgagagatcgggctttcacttcggtgacctagtgacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggtgtctacagtgggttaatccccaaaagacatctcagttcggattgtcgtctgcaactcgacggcatgaagtcggaatcgctagtaatcgcgtaacagcatgacgcggtgaatacgttcccgggccttgtacacaccgcccgtcacaccatgggagttgggttcacccgaaggccgtgcgccaacctttacagggggcagcggaccacggtgagctcagcgactggggtgaagtcgtaacaaggtagccgtaggggaacctgcggctggatcacctcctttcta

SEQ ID NO: 8241 - DNA, 1040 bp, Salipiger sp. D13
  misc_feature (265)..(265): n is a, c, g, or t
  ref <308>: DATABASE ACCESSION NUMBER: NCBI ACCESSION: NZ_ML112614.1
  ref <309>: DATABASE ENTRY DATE: 2019-04-01
  ref <313>: RELEVANT RESIDUES IN SEQ ID NO: (1)..(1040)
ggaagataatgacggtacccagtaaagaaaccccggctaactccgtgccagcagccgcggtaatacggagggggttagcgttgttcggaattactgggcgtaaagcgcgcgtaggcggactggaaagttgggggtgaaatcccggggctcaacctcggaactgcctccaaaactatcagtctagagttcgagagaggtgagtggaactccgagtgtagaggtgaaattcgtagatattcggaggaacaccagtggcgaaggcggntgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccacccgagagatcgggctttcacttcggtgacctagtgacaggtgctgcatggctgtcgtcagctcgtgtcgtgagatgttcggttaagtccggcaacgagcgcaacccacatccctagttgccagcagtttggctgggcactctatggaaactgcccgtgataagcgggaggaaggtgtggatgacgtcaagtcctcatggcccttacgggttgggctacacacgtgctacaatggtgtctacagtgggttaatccccaaaagacatctcagttcggattgtcgtctgcaactcgacggcatgaagtcggaatcgctagtaatcgcgtaacagcatgacgcggtgaatacgttcccgggccttgtacacaccgcccgtcacaccatgggagttgggttcacccgaaggccgtgcgccaacctttacagggggcagcggaccacggtgagctcagcgactggggtgaagtcgtaacaaggtagccgtaggggaacctgcggctggatcacctcctttctaa

SEQ ID NO: 8242 - DNA, 1466 bp, Salipiger sp. IMCC34102
  ref <308>: DATABASE ACCESSION NUMBER: NCBI ACCESSION: NZ_SELQ01000018.1
  ref <309>: DATABASE ENTRY DATE: 2019-04-01
  ref <313>: RELEVANT RESIDUES IN SEQ ID NO: (1)..(1466)
tcaacttgagagtttgatcctggctcagaacgaacgctggcggcacgcctaacacatgcaagtcgagcgaggtcttcggacctagcggcggacgggttagtaacgcgtgggaacgtacccttttctacggaatagcctcgggaaactgggagtaataccgtatacgcccttttggggaaagatttatcggtgaaggatcggcccgcgttagattagatagttggtggggtaatggcctaccaagtctacgatctatagctggtttgagaggatgatcagcaacactgggactgagacacggcccagactcctacgggaggcagcagtggggaatcttagacaatgggcgcaagcctgatctagcgatgccgcgtgtgtgacgaaggccttagggtcgtaaagcactttcgccagggatgataatgacagtacctggtaaagaaaccccggctaactccgtgccagcagccgcggtaatacggagggggttagcgttgttcggaattactgggcgtaaagcgcacgtaggcggattggaaagttgggggtgaaatcccagggctcaaccctggaactgcctccaaaactatcagtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcagggggcttgccctttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgggaccgccagagagatctggtttcctcgtaagaggctcagtgacaggtgctgcatggctgtcgtcagctcgtgtcgtgagatgttcggttaagtccggcaacgagcgcaacccacatccttagttgccagcattcagttgggcactctagggaaactgcccgtgataagcgggaggaaggtgtggatgacgtcaagtcctcatggcccttacgggttgggctacacacgtgctacaatggtgcatacagtgggttaatccccaaaatgcatctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaaccttttggaggcagcggaccacggtaggatcagcgactggggtgaagtcgtaacaaggtagccgtaggggaacctgcggctggatcacctcctttctaa

SEQ ID NO: 8243 - DNA, 1467 bp, Salipiger thiooxidans
  ref <308>: DATABASE ACCESSION NUMBER: NCBI ACCESSION: NZ_FNAV01000060.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcaccttcgggtgagcggcggacgggtgagtaacgcgtgggaacgtgcccttctctgcggaatagccactggaaacggtgagtaataccgcatacgcccttcgggggaaagatttatcggagaaggatcggcccgcgttagattaggtagttggtggggtaatggcctaccaagcctacgatctatagctggtttgagaggatgatcagccacactgggactgagacacggcccagactcctacgggaggcagcagtggggaatcttagacaatgggcgcaagcctgatctagccatgccgcgtgagtgatgaaggccttagggtcgtaaagctctttcgctggggaagataatgactgtacccagtaaagaaaccccggctaactccgtgccagcagccgcggtaatacggagggggttagcgttgttcggaattactgggcgtaaagcgcgcgtaggcggatcagaaagttgggggtgaaatcccggggctcaacctcggaactgcctccaaaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccgccagagagatttggctttcacttcggtgacctagtgacaggtgctgcatggctgtcgtcagctcgtgtcgtgagatgttcggttaagtccggcaacgagcgcaacccacatcttcagttgccagcagttcggctgggcactctggagaaactgcccgtgataagcgggaggaaggtgtggatgacgtcaagtcctcatggcccttacgggttgggctacacacgtgctacaatggtgcctacagtgggttaatccccaaaaggcatctcagttcggattgtcgtctgcaactcgacggcatgaagtcggaatcgctagtaatcgcgtaacagcatgacgcggtgaatacgttcccgggccttgtacacaccgcccgtcacaccatgggagttgggtctacccgaagacggtgcgccaacctttcgagggggcagctggccacggtaggctcagcgactggggtgaagtcgtaacaaggtagccgtaggggaacctgcggctggatcacctcctttctaa

SEQ ID NO: 8244 - DNA, 1041 bp, Salirhabdus sp. Marseille-P4669
  ref <308>: DATABASE ACCESSION NUMBER: NCBI ACCESSION: NZ_OEQK01000006.1
  ref <309>: DATABASE ENTRY DATE: 2019-04-01
  ref <313>: RELEVANT RESIDUES IN SEQ ID NO: (1)..(1041)
tggagagtttgatcctggctcaggacgaacgctggcggcgtgcctaatacatgcaagtcgagcgcgggaagcaagcaatcgcccttcggggcgtgcgcttgtggaacgagcggcggacgggtgagtaacacgtgggcaacctgcctgtaagactgggataacttcgggaaaccggagctaataccggataatacttttggatgcatgtccgaaagatgaaagacggcttttgctgtcacttacagatgggcccgcggcgcattagctagttggtggggtaaaggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggtcttcggatcgtaaagctctgttgttagggaagaacaagtacgagagtaactgctcgtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccacggcttaaccgtggagggtcattggaaactgggagacttgagtgcagaagaggagagtggaattccacgtgtagcggtgaaatgcgtagatatgtggaggaacaccagtggcgaaggcgactctctggtctgtaactgacgctgaggcgcgaaagcgtggggagcgaacaggattagataccctggtagtccacgccgtaaacgatgagtgctaggtgttagggggtttccgccccttagtgctgaagttaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctctgacaatcctagagataggac

SEQ ID NO: 8245 - DNA, 1527 bp, Salisaeta longa
  ref <308>: DATABASE ACCESSION NUMBER: NCBI ACCESSION: NZ_ATTH01000001.1
  ref <309>: DATABASE ENTRY DATE: 2019-04-01
  ref <313>: RELEVANT RESIDUES IN SEQ ID NO: (1)..(1527)
tacaacggagagtttgatcctggctcaggacgaacgctggcggcaggcttaacacatgcaagtcgcacgagaacgcaccttcgggtgcaagtaaagtggcgaacgggtgagtaacgcgtatacaacctgcctttgagcgggggataactacgggaaactgtagctaataccgcacgacgttgcagagatgcatatttctgcaatcaaagccttcgggcgctcaaagatgggtatgcgtcgaattagcttgttggtgaggtaacggctcaccaaggcaacgattcgtagctggtctgagaggatgatcagtcacactggcactgagacacgggccagactcctacgggaggcagcagtggggaatcttaggcaatgggggaaaccctgacctagccatgccgcgtggaggaagacacccctatggggcgtaaactccttttctgtcggaagaaaaccctgttttgcagggcgtgacggtacgacaggaataagcaccggctaactccgtgccagcagccgcggtaatacggagggtgcaagcgttgtccggaatcactgggcgtaaagggtgtgtaggtgggacagcaagtcagaggtgaaagcctgcggcttaaccgtagaagtgcctttgaaactgctgttcttgagtcctggagaagttgtcggaattcgtggtgtagcggtgaaatgcgtagatatcacgaggaacaccagaagcgtaagcggacaactagacgggtactgacactgaggcacgaaagcgtggggagcaaacaggattagataccctggtagtccacgccgtaaacgatgaatgctcgccgttatcctaattgtggggtagtggctaagttaacgcgttaagcattccgcctggggagtacgatcgcaagattgaaactcaaaggaattgacgggggcccgcacaagcggtggagcatgtggcttaattcgatgcaacgcgaagaaccttacctaggctcgaacactatcggaccgctcccgaaaaggagcttcccttcggggctgatagtgaggtgctgcatggctgtcgtcagctcgtgtcgtgagatgttgggttaagtcccgcaacgagcgcaacccctattgctagttaccagcacgttatggtggggactctagtgagactgcctgcgcaagcagtgaggaaggtggggatgacgtcaagtcatcatggcccttacgcctagggctgcacacgtgctacaatggccggtacaatgggcagccgctccgcgaggagtagcgaatccccaaagccggtcctagtccggattggagtctgcaactcgactccatgaagacggaatcgctagtaatcgcgtatcagcaatgtcgcggtgaatacgttcccgggccttgtacacaccgcccgtcaagccatggaagctgggagtgcccgaagtccgtgccccgtaagggagcggccgaaggtaagctcagtgactggggctaagtcgtaacaaggtagccgtaccggaaggtgcggctggatcacctcctaaa

SEQ ID NO: 8246 - DNA, 1546 bp, Salisediminibacterium haloalkalitolerans
  ref <308>: DATABASE ACCESSION NUMBER: NCBI ACCESSION: NZ_FOGV01000054.1
  ref <309>: DATABASE ENTRY DATE: 2019-04-01
  ref <313>: RELEVANT RESIDUES IN SEQ ID NO: (1)..(1546)
acgaacgctggcggcgtgcctaatacatgcaagtcgagcgcgtgaaaccggcggatcccttcggggtgaaaccggtggaacgagcggcggacgggtgagtaacacgtggacaacttaccttgcagactgggataactccgggaaaccggagctaataccggataggtcatcggatcgcctgatccgatgataaaagcgggagcttcgctctcgccctgcaagatgggtccgcggcgcattagttagttggtgaggtaacggctcaccaaggcgacgatgcgtagccgacctgagagggtgatcggccacactgggactgagacacggcccagactcctacgggaggcagcagtagggaatcatccgcaatggacgaaagtctgacggtgcaacgccgcgtgaacgatgaaggttttcggatcgtaaagttctgttgtgagggaagaacaggttccgttcgaagagggcggagctatgacggtacctcacgagaaagccccggctaactacgtgccagcagccgcggtaatacgtagggggcaagcgttgtccggaattattgggcgtaaagcgcgcgcaggcggtctcttaagtctgatgtgaaatcttgcggctcaaccgcaagctggcattggaaactgggagacttgagtgtaggagaggaaagtggaattccacgtgtagcggtgaaatgcgtagatatgtggaggaacaccagtggcgaaggcgactttctggcctacaactgacgctgaggtgcgaaagcgtggggagcaaacaggattagataccctggtagtccacgctgtaaacgttgagtgctaggtgttaggggtttcgatacccttagtgccgaagttaacacattaagcactccgcctggggagtacggccgcaaggctgaaactcaaaggaattgacgggggcccgcacaagcagtggagcatgtggtttaattcgacgcaacgcgaagaaccttaccaggtcttgacatcctctgaacatccgagagatcgggttttccccttcgggggacagagtgacaggtggtgcatggttgtcgtcagctcgtgtcgtgagatgttgggttaagtcccgtaacgagcgcaacccctgatcttagttgccagcattgagttgggcactctaaggtgactgccggtgacaaaccggaggaaggcggggatgacgtcaaatcatcatgccccttatgacctgggctacacacgtgctacaatggatggtacaacgggcagcgaagccgcgaggtggagccaatcccataaagccattctcagttcggattgcaggctgcaactcgcctgcatgaagccggaattgctagtaatcgcggatcagcatgccgcggtgaatacgttcccgggccttgtacacaccgcccgtcacaccacgagagcttgtaacacccgaagtcggtgcggcaacccttaggggagccagccgccgaaggtgggacaggtgattggggtgaagtcgtaacaaggtatccgtaccggaaggtgcggatggatcacctcctttctaa

SEQ ID NO: 8247 - DNA, 1487 bp, Salisediminibacterium halotolerans
  ref <308>: DATABASE ACCESSION NUMBER: NCBI ACCESSION: NZ_RKQQ01000011.1
  ref <309>: DATABASE ENTRY DATE: 2019-04-01
  ref <313>: RELEVANT RESIDUES IN SEQ ID NO: (1)..(1487)
tttatctgagagtttgatcctggctcaggacgaacgctggcggcgtgcctaatacatgcaagtcgagcgcgtgaaaccggcggatcccttcggggtgaaaccggtggaacgagcggcggacgggtgagtaacacgtggacaacttaccttgcagactgggataactccgggaaaccggagctaataccggataggtcatcggatcgcctgatccgatgataaaagcgggagcttcgctctcgccctgcaagatgggtccgcggcgcattagttagttggtgaggtaacggctcaccaaggcgacgatgcgtagccgacctgagagggtgatcggccacactgggactgagacacggcccagactcctacgggaggcagcagtagggaatcatccgcaatggacgaaagtctgacggtgcaacgccgcgtgaacgatgaaggttttcggatcgtaaagttctgttgtgagggaagaacaggttccgttcgaatagggcggagctatgacggtacctcacgagaaagccccggctaactacgtgccagcagccgcggtaatacgtagggggcaagcgttgtccggaattattgggcgtaaagcgcgcgcaggcggtctcttaagtctgatgtgaaatcttgcggctcaaccgcaagctggcattggaaactgggagacttgagtgtaggagaggaaagtggaattccacgtgtagcggtgaaatgcgtagatatgtggaggaacaccagtggcgaaggcgactttctggcctacaactgacgctgaggtgcgaaagcgtggggagcaaacaggattagataccctggtagtccacgctgtaaacgttgagtgctaggtgttaggggtttcgatacccttagtgccgaagttaacacattaagcactccgcctggggagtacggccgcaaggctgaaactcaaaggaattgacgggggcccgcacaagcagtggagcatgtggtttaattcgacgcaacgcgaagaaccttaccaggtcttgacatcctctgaacatccgagagatcgggttttccccttcgggggacagagtgacaggtggtgcatggttgtcgtcagctcgtgtcgtgagatgttgggttaagtcccgtaacgagcgcaacccctgatcttagttgccagcattgagttgggcactctaaggtgactgccggtgacaaaccggaggaaggcggggatgacgtcaaatcatcatgccccttatgacctgggctacacacgtgctacaatggatggtacaacgggcagcgaagccgcgaggtggagccaatcccataaagccattctcagttcggattgcaggctgcaactcgcctgcatgaagccggaattgctagtaatcgcggatcagcatgccgcggtgaatacgttcccgggccttgtacacaccgcccgtcacaccacgagagcttgtaacacccgaagtcggtgcggcaacccttatgggagc

SEQ ID NO: 8248 - DNA, 1572 bp, Saliterribacillus persicus
  ref <308>: DATABASE ACCESSION NUMBER: NCBI ACCESSION: NZ_QPJJ01000028.1
  ref <309>: DATABASE ENTRY DATE: 2019-04-01
  ref <313>: RELEVANT RESIDUES IN SEQ ID NO: (1)..(1572)
ttatggagagtttgatcttggctcaggacgaacgctggcggcgtgcctaatacatgcaagtcgagcgcgggaagcagcggatcacccttcggggtgtgaagctgtggaacgagcggcggacgggtgagtaacacgtgggcaacctgcctgtaagactgggataaccccgggaaaccggggctaataccggataatacttctgatcgcatgtgacgaagttgaaaggcggctcttcggagctgtcacttacagatgggcccgcggcgcattagctagttggtagggtaacggcctaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgaagaaggtcttcggatcgtaaagttctgttgttagggaagaacaagtaccgttctaacaggacggtaccttgacggtacctatcgaggaagccccggctaactacgtgccagcagccgcggtaatacgtagggggcaagcgttgtccggaattattgggcgtaaagcgcgcgcaggcggttccttaagtctgatgtgaaatcttgcggctcaaccgcaagcggtcattggaaactggggaacttgagtacagaagaggagagtggaattccacgtgtagcggtgaaatgcgtagatatgtggaggaacaccagtggcgaaggcggctctctggtctgtaactgacgctgaggcgcgaaagcgtggggagcaaacaggattagataccctggtagtccacgccgtaaacgatgagtgctaggtgttagggggtttccgccccttagtgctgcagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatccgctgacagctctagagatagagtgttcccttcggggacagcgtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggacgacgtcaaatcatcatgccccttatgacctgggctacacacgtgctacaatggatgatacaaagggcagcgaagccgcgaggtgtagcaaatcccataaaatcattctcagttcggattgtaggctgcaactcgcctacatgaagccggaatcgctagtaatcgcggatcagcatgccgcggtgaatacgttcccgggccttgtacacaccgcccgtcacaccacgagagttggcaacacccgaagtcggtgagataacctttatggagtcagccgccgaaggtggggccaatgattggggtgaagtcgtaacaaggtagccgtatcggaaggtgcggctggatcacctcctttcta

SEQ ID NO: 8249 - DNA, 1554 bp, Salmonella enterica
  ref <308>: DATABASE ACCESSION NUMBER: NCBI ACCESSION: NZ_LR134232.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtggctaataccgcataacgtcgcaagaccaaagagggggaccttcgggcctcttgccatcagatgtgcccagatgggattagctagttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtctacttggaggttgtgcccttgaggcgtggcttccggagctaacgcgttaagtagaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 8250 - DNA, 1552 bp, Salmonella sp. SEH-2
  ref <308>: DATABASE ACCESSION NUMBER: NCBI ACCESSION: NZ_PXVG01000029.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtggctaataccgcataacgtcgcaagaccaaagagggggaccttcgggcctcttgccatcagatgtgcccagatgggattagctagttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtctacttggaggttgtgcccttgaggcgtggcttccggagctaacgcgttaagtagaccgcctggggagtacggccgcaaggttaaaactcaaatgaattgacgggggcccgcacaagcggtggagcatgtggtttaattcgatgcaacgcgaagaaccttacctggtcttgacatccacagaagaatccagagatggatttgtgccttcgggaactgtgagacaggtgctgcatggctgtcgtcagctcgtgttgtgaaatgttgggttaagtcccgcaacgagcgcaacccttatcctttgttgccagcgattaggtcgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 8251 - DNA, 1554 bp, Salmonella sp. SSDFZ54
  ref <308>: DATABASE ACCESSION NUMBER: NCBI ACCESSION: NZ_CP034819.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtggctaataccgcataacgtcgcaagaccaaagagggggaccttcgggcctcttgccatcagatgtgcccagatgggattagcttgttggtgaggtaacggctcaccaaggcaacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtctacttggaggttgtgcccttgaggcgtggcttccggagctaacgcgttaagtagaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcgattaggtcgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaaagaagc

SEQ ID NO: 8252 - DNA, 1554 bp, Salmonella sp. SSDFZ69
  ref <308>: DATABASE ACCESSION NUMBER: NCBI ACCESSION: NZ_CP034831.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaagcagcttgctgctttgctgacgagtggcggacgggtgagtaatgtctgggaaactgcctgatggagggggataactactggaaacggtggctaataccgcataacgtcgcaagaccaaagagggggaccttcgggcctcttgccatcagatgtgcccagatgggattagctagttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgcggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtctacttggaggttgtgcccttgaggcgtggcttccggagctaacgcgttaagtagaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaaagaagc

SEQ ID NO: 8253 - DNA, 1489 bp, Sandarakinorhabdus cyanobacteriorum
  ref <308>: DATABASE ACCESSION NUMBER: NCBI ACCESSION: NZ_NOXT01000120.1
  ref <309>: DATABASE ENTRY DATE: 2019-04-01
  ref <313>: RELEVANT RESIDUES IN SEQ ID NO: (1)..(1489)
aacttgagagtttgatcctggctcagaacgaacgctggcggcatgcctaacacatgcaagtcgaacgaagccttcgggcttagtggcgcacgggtgcgtaacgcgtgggaatctgccttcaggtacggaataactcagggaaacttgtgctaataccgtatgatgacttcggtccaaagatttatcgcctgaagatgagcccgcgtaggattagctagttggtggggtaaaggcctaccaaggcgacgatccttagctggtctgagaggatgatcagccacactgggactgagacacggcccagactcctacgggaggcagcagtggggaatattggacaatgggcgaaagcctgatccagcaatgccgcgtgagtgaagaaggccttcgggttgtaaagctcttttacccgggatgataatgaccgtaccgggagaataagccccggctaactccgtgccagcagccgcggtaatacggagggggctagcgttgttcggaatcactgggcgtaaagcgtgcgtaggcggctattcaagtcagaggtgaaagcctggggctcaaccccagaactgcctttgaaactaggtagcttgaacacgggagaggtgagtggaattccgagtgtagaggtgaaattcgtagatattcggaagaacaccagtggcgaaggcggctcactggaccgttgttgacgctgaggcacgaaagcgtggggagcaaacaggattagataccctggtagtccacgccgtaaacgatgacaactagctgtcggggctcttggagctccggtggcgcagctaacgcattaagttgtccgcctggggagtacggtcgcaagattaaaactcaaaggaattgacgggggcctgcacaagcggtggagcatgtggtttaattcgaagcaacgcgcagaaccttaccagcgtttgacatcgcaggacgatttccagagatggatttcttctcgcaagagacttgcagacaggtgctgcatggctgtcgtcagctcgtgtcgtgagatgttgggttaagtcccgcaacgagcgcaaccctcgcctttagttaccatcattcagttggggactctaaaggaaccgccggtgataagccggaggaaggtggggatgacgtcaagtcctcatggcccttacgcgctgggctacacacgtgctacaatggcggtgacaatgggctgcaaacccgcgagggggagctaatctcaaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattgacccgaaggcagtgggctaaccgcaaggaggcagctgaccacggtcggttcagtgactggggtgaagtcgtaacaaggtagccgtaggggaacctgcggctggatcacctcctttctaag

SEQ ID NO: 8254 - DNA, 1493 bp, Sandarakinorhabdus limnophila
  ref <308>: DATABASE ACCESSION NUMBER: NCBI ACCESSION: NZ_ATVO01000004.1
  ref <309>: DATABASE ENTRY DATE: 2019-04-01
  ref <313>: RELEVANT RESIDUES IN SEQ ID NO: (1)..(1493)
aacttgagagtttgatcctggctcagaacgaacgctggcggcatgcctaacacatgcaagtcgaacgaacccttcggggttagtggcgcacgggtgcgtaacgcgtgggaatctgcccttaggtacggaataacagtgagaaattactgctaataccgtatgatgtcttcggaccaaagatttatcgcctagggatgagcccgcgtaggattagctagttggtgaggtaaaggctcaccaaggctacgatccttagctggtctgagaggatgatcagccacactgggactgagacacggcccagactcctacgggaggcagcagtggggaatattggacaatgggcgaaagcctgatccagcaatgccgcgtgagtgaagaaggccttcgggttgtaaagctcttttacccgggaagataatgaccgtaccgggagaataagccccggctaactccgtgccagcagccgcggtaatacggagggggctagcgttgttcggaatcactgggcgtaaagcgtgcgtaggcggccattcaagtcagaggtgaaagcccagggctcaaccctggaactgcctttgaaactagatggctggaacacgggagaggtgagtggaattccgagtgtagaggtgaaattcgtagatattcggaagaacaccagtggcgaaggcggctcactggaccgttgttgacgctgaggcacgaaagcgtggggagcaaacaggattagataccctggtagtccacgccgtaaacgatgataactagctgttggggctcttggagctccagtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgcctggacggtttccagagatggattccttctcgcaagagactaggacacaggtgctgcatggctgtcgtcagctcgtgtcgtgagatgttgggttaagtcccgcaacgagcgcaaccctcgcctttagttaccatcattcagttggggactctaaaggaaccgccggtgataagccggaggaaggtggggatgacgtcaagtcctcatggcccttacacgctgggctacacacgtgctacaatggcggtgacaatgggctgcaaacccgcgagggtgagctaatctcaaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattgacccgaaggcagtgggctaacccgcaagggaggcagctgaccacggtcggttcagtgactggggtgaagtcgtaacaaggtagccgtaggggaacctgcggctggatcacctcctttctaagga

SEQ ID NO: 8255 - DNA, 1493 bp, Sandarakinorhabdus sp. AAP62
  ref <308>: DATABASE ACCESSION NUMBER: NCBI ACCESSION: NZ_ANFY01000003.1
  ref <309>: DATABASE ENTRY DATE: 2019-04-01
  ref <313>: RELEVANT RESIDUES IN SEQ ID NO: (1)..(1493)
aacttgagagtttgatcctggctcagaacgaacgctggcggcatgcctaacacatgcaagtcgaacgaagccttcgggcttagtggcgcacgggtgcgtaacgcgtgggaatctgcccttgggtacggaataacagtgagaaattactgctaataccgtatgatgtcttcggaccaaagatttatcgcccaaggatgagcccgcgtaggattagctagttggtgaggtaaaggctcaccaaggctacgatccttagctggtctgagaggatgatcagccacactgggactgagacacggcccagactcctacgggaggcagcagtggggaatattggacaatgggcgaaagcctgatccagcaatgccgcgtgagtgaagaaggccttcgggttgtaaagctcttttacccgggaagataatgaccgtaccgggagaataagccccggctaactccgtgccagcagccgcggtaatacggagggggctagcgttgttcggaatcactgggcgtaaagcgtgcgtaggcggccattcaagtcagaggtgaaatcccagggctcaaccctggaactgcctttgaaactaggtggctggaacacgggagaggtgagtggaattccgagtgtagaggtgaaattcgtagatattcggaagaacaccagtggcgaaggcggctcactggaccgttgttgacgctgaggcacgaaagcgtggggagcaaacaggattagataccctggtagtccacgccgtaaacgatgataactagctgttggggctcttggagctccggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgcctggacggtttccagagatggattccttctcgcaagagactaggacacaggtgctgcatggctgtcgtcagctcgtgtcgtgagatgttgggttaagtcccgcaacgagcgcaaccctcgcctttagttaccatcattcagttggggactctaaaggaaccgccggtgataagccggaggaaggtggggatgacgtcaagtcctcatggcccttacacgctgggctacacacgtgctacaatggcggtgacaatgggctgcaaacccgcgagggtgagctaatctcaaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattgacccgaaggcagtgggctaacccgcaagggaggcagctgaccacggtcggttcagtgactggggtgaagtcgtaacaaggtagccgtaggggaacctgcggctggatcacctcctttctaagga

SEQ ID NO: 8256 - DNA, 1520 bp, Schleiferia sp. LA
  ref <308>: DATABASE ACCESSION NUMBER: NCBI ACCESSION: NZ_BHZE01000041.1
  ref <309>: DATABASE ENTRY DATE: 2019-04-01
  ref <313>: RELEVANT RESIDUES IN SEQ ID NO: (1)..(1520)
acaacggagagtttgatcctggctcaggatgaacgctagcggcaggcctaacacatgcaagtcgaacggcagttacgagcgatcgtagcgagagtggcgcacgggtgcgtaacgcgtatgcaacctaccccatactgggggatagcccggagaaattcggattaataccccataacattacttaactgcatgggtaagtaattaaagctgaggcggtatgggatgggcatgcgtccgattaggtagttggtagggtaacggcctaccaagccgacgatcggtaggggaactgagaggttgatcccccacactggtactgagacacggaccagactcctacgggaggcagcagtgaggaatattgggcaatggccgcaaggctgacccagccatgccgcgtgcaggaagaaggccctatgggttgtaaactgcttttctcagggggtaaacccaggctcgtgagcttggctgaaagtacctgaggaataagcatcggctaactccgtgccagcagccgcggtaatacggaggatgcgagcgttatccggattcattgggtttaaagggtccgtaggcggtttgttaagtcaggggtgaaatccttcagctcaactgaagaattgcctttgatactggcaggctagagtgcgacagaggtggatggaatgtgtcaagtagcggtgaaatgcatagatatgacacagaacaccgattgcgaaggcagttcactaggtcgcaactgacgctgatggacgaaagcgtggggagcaaacaggattagataccctggtagtccacgctgtaaacgatgattactcgctgttgggcagtaattgttcagcggctaagcgaaagcgttaagtaatccacctggggagtacggccgcaaggttgaaactcaaaggaattgacgggggcccgcacaagcggtggagcatgtggtttaattcgatgatacgcgaggaaccttacctgggcttaaatgcagggcgacggacttggaaacgagtctttccgcgaggacggcctgcaaggtgctgcatggttgtcgtcagctcgtgccgtgaggtgtcgggttaagtcccataacgagcgcaacccctacccttagttaccagcgggtcaagccggggactctaaggggactgccggcgcaagccgagaggaaggaggggatgacgtcaaatcatcacggcccttacgtccagggctacacacgtgctacaatggcggttacagagggcagccaccacgcgagtgggagcgaatccttaaagaccgtctcagttcggattggagtctgcaactcgactccatgaagctggaatcgctagtaatcgcgcatcagccatggcgcggtgaatacgttcccgggccttgtacacaccgcccgtcaagccatgggagccgggggtacctgaagtcggtaaccgcaaggagctgcctagggtaaaaccggtgactggggctaagtcgtaacaaggtagccgtaccggaaggtgcggctggaatacctcctt

SEQ ID NO: 8257 - DNA, 1527 bp, Schleiferia thermophila
  ref <308>: DATABASE ACCESSION NUMBER: NCBI ACCESSION: NZ_BHZF01000012.1
  ref <309>: DATABASE ENTRY DATE: 2019-04-01
  ref <313>: RELEVANT RESIDUES IN SEQ ID NO: (1)..(1527)
tacaacggagagtttgatcctggctcaggatgaacgctagcggcaggcctaacacatgcaagtcgaacggtagtcagcagcaatgttgacgagagtggcgcacgggtgcgtaacgcgtatgtaacctgccccatactgggggatagcctcccgaaagggagattaataccccatggtaatactgagttgcatgacttggtatttaaagctgaggcggtatgggatgggcatgcgtccgattaggtagttggtagggtaaaggcctaccaagcctacgatcggtaggggaactgagaggttggtcccccacactggtactgagacacggaccagactcctacgggaggcagcagtgaggaatattgggcaatggccgcaaggctgacccagccatgccgcgtgcaggaagaaggccctatgggttgtaaactgcttttctcagggggtaaaccctcttacgtgataggaggctgaaagtacctgaggaataagcatcggctaactccgtgccagcagccgcggtaatacggaggatgcgagcgttatccggattcattgggtttaaagggtccgtaggcggtttgttaagtcaggggtgaaatccttcagctcaactgaagaattgcctttgatactggcaggctagagtgcgacagaggtggatggaatgtgtcaagtagcggtgaaatgcatagatatgacacagaacaccgattgcgaaggcagttcactgggtcgcaactgacgctgatggacgaaagcgtggggagcaaacaggattagataccctggtagtccacgccctaaacgatgatcacttgctgttggttcgtcagatgaatcagtggcaaagcgaaagcgttaagtgatccacctggggagtacggccgcaaggttgaaactcaaaggaattgacgggggcccgcacaagcggtggagcatgtggtttaattcgatgatacgcgaggaaccttacctgggcttaaatgcaggctgacggacttggaaacaggtttttccttcgggacggcttgcaaggtgctgcatggttgtcgtcagctcgtgccgtgaggtgttgggttaagtcccctaacgagcgcaacccctacccttagttaccagcgggagagccggggactctaagggaactgcccccgtaaggggagaggaaggaggggatgacgtcaaatcatcacggcccttacgtccagggctacacacgtgctacaatggcggttacagagggcagccacctggcgacagggagctaatccttaaagaccgtctcagttcggattggagtctgcaactcgactccatgaagctggaatcgctagtaatcgcgcatcagccatggcgcggtgaatacgttcccgggccttgtacacaccgcccgtcaagccatgggagccgggggtacctgaagtcggtaaccgcaaggagctgcctagggtaaaaccggtgactggggctaagtcgtaacaaggtagccgtaccggaaggtgcggctggaatacctccttttta

SEQ ID NO: 8258 - DNA, 1144 bp, Schwartzia succinivorans
  ref <308>: DATABASE ACCESSION NUMBER: NCBI ACCESSION: NZ_FQUG01000001.1
  ref <309>: DATABASE ENTRY DATE: 2019-04-01
  ref <313>: RELEVANT RESIDUES IN SEQ ID NO: (1)..(1144)
ctgataccaaaggcggagcaatccgtcacctgaggatgggcctgcgtctgattaggtagttggtgaggtaacggcccaccaagccgacgatcagtagccggtctgagaggatgaacggccacattgggactgagacacggcccagactcctacgggaggcagcagtggggaatcttccgcaatgggcgaaagcctgacggagcaacgccgcgtgagtgaagaaggtcttcggatcgtaaagctctgttgtcggggacgaaggggcagatcaggaaatgggtctgcttagacggtacctgacgaggaagccacggctaactacgtgccagcagccgcggtaatacgtaggcggcaagcgttgtccggaatcattgggcgtaaagggagcgcaggtgggacggtaagtctttcttaaaagtgcggggctcacccccgtgaggggaaagaaactatcgttcttgagtgcaggagaggaaagcggaattcctagtgtagcggtgaaatgcgtagatattaggaagaacaccagtggcgaaggcggctttctggactgtaactgacactgaggctcgaaagccaggggagcgaacgggattagataccccggtagtcctggccgtaaacgatggatactaggtgtaggaggtatcgaccccttctgtgccggagttaacgcaataagtatcccgcctggggagtacggtcgcaagattgaaactcaaaggaattgacgggggcccgcacaagcggtggagtatgtggtttaattcgacgcaacgcgaagaaccttaccagggcttgacattgatcgaaagcgccagagatggtgccctctcttcggagacgagaaaacaggtggtgcatggctgtcgtcagctcgtgtcgtgagatgttgggttaagtcccgcaacgagcgcaacccctatgctttgttgccagcacgtaaaggtgggcactcaaaggagactgccgcggagaacgcggaggaaggcggggatgacgtcaagtcatcatgccccttatgtcctgggctacacacgtactacaatgggatggacagagagcagcgaccccgcgagggtaagcgaacctcataaaccatctcccagttcggattgcaggctgaaacccgcctgcatgaagt

SEQ ID NO: 8259 - DNA, 1492 bp, Scytonema hofmannii
  ref <308>: DATABASE ACCESSION NUMBER: NCBI ACCESSION: NZ_KQ976354.1
  ref <309>: DATABASE ENTRY DATE: 2019-04-01
  ref <313>: RELEVANT RESIDUES IN SEQ ID NO: (1)..(1492)
aaaacggagagtttgatcctggctcaggatgaacgctggcggtatgcttaacacatgcaagtcgaacggaacctttaggggtttagtggcggacgggtgagtaacgcgtgagaatctggcttcaggtctgggacaacagttggaaacggctgctaataccggatgtgcccatgggtgaaaggcttgctgcctgaagatgagctcgcgtccgattagttagttggtgtggtaagagcgcaccaagacggcgatcggtagctggtctgagaggacgatcagccacactggaactgagacacggtccagactcctacgggaggcagcagtggggaattttccgcaatgggcgaaagcctgacggagcaataccgcgtgagggaggaaggctcttgggttgtaaacctcttttctcagggaataaaaaaatgaaggtacttgaggaataagcatcggctaactccgtgccagcagccgcggtaatacggaggatgcaagcgttatccggaatgattgggcgtaaagcgtccgcaggtggtttatcaagtcggctgtcaaagcgtctggctcaactagataagggcagtggaaactgagagactagagtaaggtaggggtagagggaattcctggtgtagcggtgaaatgcgtagagatcaggaagaacaccggtggcgaaagcgctctgctggactattactgacactgagggacgaaagctaggggagcgaatgggattagataccccagtagtcctagccgtaaacgatggatactaggcgttacgcgtatcgacccgcgtagtgccggagccaacgcgttaagtatcccgcctggggagtacgccggcaacggtgaaactcaaaggaattgacgggggcccgcacaagcggtggagtatgtggtttaattcgatgcaacgcgaagaaccttaccagggcttgacatgtcgcgaatcggagggaaactttcgagtgccttagggagcgcgaacacaggtggtgcatggctgtcgtcagctcgtgtcgtgagatgttgggttaagtcccgcaacgagcgcaaccctcgtacttagttgccatcattaagttgggaactctaaggagactgccggtgacaaaccggaggaaggtggggatgacgtcaagtcagcatgccccttacgtcctgggctacacacgtactacaatgctatggacagagggcagcaagcatgtgaatgcaagcaaatctcacaaaccatggctcagttcagatcgcaggctgcaactcgcctgcgtgaaggtggaatcgctagtaattgcaggtcagcatactgcagtgaattcgttcccgggccttgtacacaccgcccgtcacaccatggaagctggtagtgcccgaagtcgttactctaaccattcgtggaggaggatgccgaaggcaggactggtgactggggtgaagtcgtaacaaggtagccgtaccggaaggtgtggctggatcacctcctttt

SEQ ID NO: 8260 - DNA, 1088 bp, Scytonema millei
  ref <308>: DATABASE ACCESSION NUMBER: NCBI ACCESSION: NZ_JTJC02000002.1
  ref <309>: DATABASE ENTRY DATE: 2019-04-01
  ref <313>: RELEVANT RESIDUES IN SEQ ID NO: (1)..(1088)
tcaaaattgagagtttgatcctggctcaggatgaacgctggcggtatgcgtaacacatgcaagtcgaacgaagtttttcggaacttagtggcggacgggtgagtaacgcgtgagaatctgccttaaggattgggacaacagtgggaaaccgctgctaataccagatatgcctataagtgaaaggagtttatctccgccttaagatgagctcgcgtctgattagctagttggtgtggtaagagcgcaccaaggcaacgatcagtagctggtttgagagaatgaccagccacactgggactgagacacggcccagactcctacgggaggcagcagtgaggaattttccgcaatgggcgaaagcctgacggagcaataccgcgtgagggaggaaggttcttggattgtaaacctcttttctcagagaagaataatgacggtatctgaggaatcagcatcggctaactccgtgccagcagccgcggtaatacggaggatgcaagcgttatccggaattattgggcgtaaagggtctgtaggtggttgttcaagtctgctgttaaagcgtctggcttaaccagataaaggcggtggaaactgaacgactagagtgcggtaggggtagagggaattcccagtgtagcggtgaaatgcgtagatcttgggaagaacacctgtggcgaaagcgctctactggaccgcaactgacactcatggacgaaagctaggggagcgaatgggattagataccccagtagtcctagccgtaaacgatggatactaggcgttgcccgtatcgacccgggcagtgtcgtagctaacgcgttaagtatcccgcctggggagtacgcacgcaagtgtgaaactcaaaggaattgacggggacccgcacaagcggtggagtatgtggtttaattcgatgcaacgcgaagaaccttaccagggtttgacatgtccggaatctcttggaaacgagagagtgccttcgggaaccggaacacaggtggtgcatggctgtcgtcagctcgtgtcgtgagatgttgggttaagtcccgcaacgagcgcaaccctcgtttttagttgccagcatt

SEQ ID NO: 8261 - DNA, 1498 bp, Scytonema tolypothrichoides
  ref <308>: DATABASE ACCESSION NUMBER: NCBI ACCESSION: NZ_JXCA01000002.1
  ref <309>: DATABASE ENTRY DATE: 2019-04-01
  ref <313>: RELEVANT RESIDUES IN SEQ ID NO: (1)..(1498)
aaaacggagagtttgatcctggctcaggatgaacgctggcggtatgcttaacacatgcaagtcgaacggagttcttcggaacttagtggcggacgggtgagtaacgcgtgagaatctggcttcaggttcgggacaacagttggaaacggctgctaataccggatgtgccttagggtgaaagatttatcacctgaagatgagctcgcgtctgattagctagtaggtgtggtaagagcgcacctaggcgacgatcagtagctggtctgagaggatgaccagccacactgggactgagacacggcccagactcctacgggaggcagcagtggggaattttccgcaatgggcgaaagcctgacggagcaataccgcgtgagggaggaaggctcttgggttgtaaacctcttttctcagggaataagtactgaaggtacctgaggaatcagcatcggctaactccgtgccagcagccgcggtaatacggaggatgcaagcgttatccggaatgattgggcgtaaagcgtccgcaggtggtttttcaagtctgctgtcaaagagtctggctcaaccagataaaggcagtggaaactgagagactagagtatggtaggggtagagggaattcctggtgtagcggtgaaatgcgtagagatcaggaagaacaccggtggcgaaagcgctctgctggaccataactgacactgagggacgaaagctaggggagcgaatgggattagataccccagtagtcctagccgtaaacgatggatactaggcgttgcccgtatcgacccgggcagtgtcgtagccaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtccggaatctcttggaaacgagagagtgccttcgggagccggaacacaggtggtgcatggctgtcgtcagctcgtgtcgtgagatgttgggttaagtcccgcaacgagcgcaaccctcgttcttagttgccagcaattcggttgggcactctagggagactgccggtgacaaaccggaggaaggtggggatgacgtcaagtcagcatgccccttacgtcctgggctacacacgtactacaatgctatggacaaagggcagcaagctagcaatagcaagcaaatcccataaaccatggctcagttcagatcgcaggctgcaactcgcctgcgtgaaggaggaatcgctagtaattgcaggtcagcatactgcagtgaattcgttcccgggccttgtacacaccgcccgtcacaccatggaagctggtcacgcccgaagtcgttaccctaacccctcggggagggggacgccgaaggtaggactggtgactggggtgaagtcgtaacaaggtagccgtaccggaaggtgtggctggatcacctcctttttaggga

SEQ ID NO: 8262 - DNA, 1528 bp, Sebaldella termitidis
  ref <308>: DATABASE ACCESSION NUMBER: NCBI ACCESSION: NZ_UGYG01000001.1
  ref <309>: DATABASE ENTRY DATE: 2019-04-01
  ref <313>: RELEVANT RESIDUES IN SEQ ID NO: (1)..(1528)
aaatattgaatgaagagtttgatcctggctcaggatgaacgctgacagaatgcttaacacatgcaagtcgatgagaagactcccttcggggagagggtatcatggcggacgggtgagtaacgcgtaaagaacttgccatatggacagggataaccgatggaaacgacggataagacctgatataatgaattaatggcatcattgattcatgaaaagcaatgccatatgagagctttgcgtcctattagctagttggtagtgtaacggacaaccaaggcgatgataggtagccggcctgagagggtggacggccacaaggggactgagatacggcccttactcttacgggaggcagcagtggggaatattggacaatggaggtaactctgatccagcaattctgtgtgcacgacgaaggtcttcggattgtaaagtgctttaagttgggaagaaaaaaatgacggtaccaacagaataagcgacggctaaatacgtgccagcagccgcggtaatacgtatgtcgcaagcgttatccggaattattgggcataaagggcatctaggcggggtttcaagtcgacggtgaaaactagtggctcaaccattagcttgccgacgaaactgaaattctagagtattggaaaggtgggcggaactacatgagtagaggtgaaattcgtagatatatgtaggaatgccgatgacgaaggtagctcactggacaaaaactgacgctgaagtgcgaaagctaggggagcaaacaggattagataccctggtagtcctagctgtaaacgatgttcactgggtgtgggcgagtagatcgtctgtgccgaagcaaatgcgataagtgaaccgcctggggagtacggccgcaaggctgaaactcaaaggaattgacggggacccgcacaagcggtggagcatgtggtttaattcgacgcaacgcgaggaaccttaccagatcttgacatctccggaattaggtagagatacttaagtgccttcgggaaccggaagacaggtggtgcatggctgtcgacagctcgtgtcgtgagatgttgggttaagtcccgcaacgagcgcaacccctatcgttagttactaacattaagttgaggactttagcgagactgcctgcgaagagcaggaggaaggtggggatgacgtcaagtcatcatgccccttatgatctgggctacacacgtgctacaatggacagtacaaagagaagcaaaatggtgacatggagcaaatcaagaaatctgttctcagttcggattgaagtctgcaactcgacttcatgaagttggaatcgctagtaatcgcggatcagcaatgccgcggtgaatacgttctcgggtcttgtacacaccgcccgtcacaccacgagagtttgttgcacctgaaattgctggcctaacccgtaagggaaggaagtactgaaggtgtggtaagcgattggggtgaagtcgtaacaaggtatccgtaccggaaggtgcggatggatcacctcctttctaaggag

SEQ ID NO: 8263 - DNA, 959 bp, Sedimentibacter sp. B4
  ref <308>: DATABASE ACCESSION NUMBER: NCBI ACCESSION: NZ_CANG01000951.1
  ref <309>: DATABASE ENTRY DATE: 2019-04-01
  ref <313>: RELEVANT RESIDUES IN SEQ ID NO: (1)..(959)
attaaacgagagtttgatcctggctcaggacgaacgctggcggcgtgcctaacacatgcaagtcgaacgaagtatattttcggatatgcttagtggcggacgggtgagtaacgcgtgaacaatctgccctgtacacaggaatagcctcgggaaactgggattaaaaccggataacacttttttctcgcatgagagagaagtcaaattgatttagaggtacaggatgagttcgcgtctgattagctagttggtgaggtaacggctcaccaaggcgacgatcagtagccggcctgagagggtgaacggccacactggaactgagacacggtccagactcctacgggaggcagcagtggggaatattgcacaatggaggaaactctgatgcagcgacgccgcgtgagtgaagaaggtcttcggatcgtaaaactctgtccttggtgacgaaaaaaatgacggtagccaaggaggaagccccggctaactacgtgccagcagccgcggtaatacgtagggggcgagcgttgtccggatttactgggcgtaaagggtgagtaggcggtaatatgtgtcagatgtaaaaggctatggcttaaccatagttggcatttgaaactgtattacttgagtgcaggagaggtaagtggaattcctagtgtagcggtgaaatgcgtagatattaggaggaacaccagtggcgaaggcgacttactggactgtaactgacgctgagtcacgaaagcgtgggtagcaaacaggattagataccctggtagtccacgctgtaaacgatgagtgctaggtgttgggtagcgatattcagtgccgaagtaaacacaataagcactccgcctggggagtacggtcgcaagactgaaactcaaaggaattgacggggacccgcacaagcagcggagcatgtggtttaattcgaagcaacgcgaagaaccttaccaagg

SEQ ID NO: 8264 - DNA, 1540 bp, Sedimentisphaera cyanobacteriorum
  ref <308>: DATABASE ACCESSION NUMBER: NCBI ACCESSION: NZ_CP019633.1
  ref <309>: DATABASE ENTRY DATE: 2019-04-01
  ref <313>: RELEVANT RESIDUES IN SEQ ID NO: (1)..(1540)
aaattgaagagtttgatcctggctcagaacgaacgctggcggcgtggttaagacatgcaagtcgcacgagcctttcatggctagtggcgaaaggatgagtaacggataggtaacgtacccgatgcacaggtatagcgtcgagagcttgctctctaccgaaaggggcggtaatacctgataacattgccagctgcagggcaggcaatcaaagatttatcggcatcggagcggcctattccctatcagttagttggtgaggtaacggctcaccaaggcaacgacgggtagcgggactgagaggttggtccgccatatcgggactgagacactgcccggacctccacggagggctgcagtaacgaatcttgggcaatgatcgaaagattgacccagcgacgccgcgtgcaggaagaagcccctcggggtgtaaactgctgtcaagagcaagtaagcgcaagcagaactactctaaaggaagtcacggctaacttcgtgccagcagccgcggtaatacgaaggtggcgagcgttgttcggaatcactgggcttaaagcgtacgcaggcggttttctaagcgttctctgaaatcccccggctcaaccggggaattggggggcgaactggaaaacttgaggcatacaggggcgggtggaactcttcgtggagcggtggaatgcgtagatatgaagaggaacgccagaggtgaaaacggcccgctgggtatgacctgacgctgaggtacgaaagcatgggtagcgaacgggattagataccccggtagtccatgccgtaaacgatgtgcactggttcgcagtaattctgacattattgcgggcgtagcaaaagtgttaagtgcaccgcctggggagtacggtcgcaaggctaaaactcaaaggaattgacgggggctcacacaagcggtggagcatgtggattaattcgaagcaacgcgcagaaccttacctgggtttgacatgtttggatgccttcctggaaacaggaccgggctgctctcttcggagagtgaaacttacacaggtgctgcatggctgtcgtcagctcgtgtcgtgagatgttgggttaagtccttgaacgagcgaaacccttgccgttagttgccagcaggttaagctggggactctaacgggactgccggtgttaaaccggaggaaggcggggatgacgtcaagtcctcatggcctttatgcccagggcttcacacgtgctacaatggcagatacagatcgacgcaaagccgtgaggttgagcaaatcgcacaaagtctgcctcagttcggattgttctctggcaactcgagaacatgaagttggaatcgctagtaatcgcgtatcagcaatgacgcggtgaatatgttcctgagccttgtacacaccgcccgtcaagtcatggaaatcgggagcacccgaagtcggcttgtcaactcttcggagagacggctgcctacggtgaactcggtaactgggactaagtcgtaacaaggtagccgtaggggaacctgcggctggatcacctcctttct

SEQ ID NO: 8265 - DNA, 545 bp, Sedimentisphaera salicampi
  ref <308>: DATABASE ACCESSION NUMBER: NCBI ACCESSION: NZ_NHPQ01000045.1
  ref <309>: DATABASE ENTRY DATE: 2019-04-01
  ref <313>: RELEVANT RESIDUES IN SEQ ID NO: (1)..(545)
cggcccgctgggtatgacctgacgctgaggtacgaaagcatgggtagcgaacgggattagataccccggtagtccatgccgtaaacgatgtgcactggttcgtggtaattctgacattatcacgggcgtagcaaaagtgttaagtgcaccgcctggggagtacggtcgcaaggctaaaactcaaaggaattgacgggggctcacacaagcggtggagcatgtggattaattcgaagcaacgcgcagaaccttacctgggtttgacatgtttgtatgcctttctggaaacagagtctggctgctctcttcggagagtgaaacttacacaggtgctgcatggctgtcgtcagctcgtgtcgtgagatgttgggttaagtccttgaacgagcgaaacccttgccgttagttgccagcaggttaagctggggactctaacgggactgccggtgttaaaccggaggaaggcggggatgacgtcaagtcctcatggcctttatgcccagggcttcacacgtgctacaatggcagatacagatcgacgcaaa

SEQ ID NO: 8266 - DNA, 1471 bp, Sedimentitalea nanhaiensis
  ref <308>: DATABASE ACCESSION NUMBER: NCBI ACCESSION: NZ_FPAW01000003.1
  ref <309>: DATABASE ENTRY DATE: 2019-04-01
  ref <313>: RELEVANT RESIDUES IN SEQ ID NO: (1)..(1471)
tcaacttgagagtttgatcctggctcagaacgaacgctggcggcaggcctaacacatgcaagtcgagcgctaccttcgggtggagcggcggacgggttagtaacgcgtgggaacatacccttctctaaggaatagccactggaaacggtgagtaataccttatacgcccttcgggggaaagatttatcggagaaggattggcccgcgtaagattagatagttggtggggtaatggcctaccaagtctacgatctttagctggttttagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcgccagagatgataatgacagtatctggtaaagaagtcccggctaactccgtgccagcagccgcggtaatacggaggggactagcgttgttcggaattactgggcgtaaagcgtacgtaggcggatcagaaagtaaggggtgaaatcccagggctcaaccctggaactgcctcttaaactcctggtcttgagttcgagagaggtgagtggaattccgagtgtagaggtgaaattcgtagatattcggaggaacaccagtggcgaaggcggctcactggctcgatactgacgctgaggtacgaaagtgtggggagcaaacaggattagataccctggtagtccacaccgtaaacgatgaatgccagacgtcgggtagcatgctattcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccgggaccgccagagagatctggttttcacttcggtgactcggtgacaggtgctgcatggctgtcgtcagctcgtgtcgtgagatgttcggttaagtccggcaacgagcgcaacccacatctttagttgccagcagttcggctgggcactctaaagaaactgcccgtgataagcgggaggaaggtgtggatgacgtcaagtcctcatggcccttacgggttgggctacacacgtgctacaatggtagtgacaatgggttaatccccaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttgggttcacccgaaggccgtgcgccaacctcttcggagggggcagcggaccacggtgagctcagcgactggggtgaagtcgtaacaaggtagccgtaggggaacctgcggctggatcacctcctttctaa

SEQ ID NO: 8267 - DNA, 1479 bp, Sedimentitalea sp. W43
  ref <308>: DATABASE ACCESSION NUMBER: NCBI ACCESSION: NZ_CP033219.1
  ref <309>: DATABASE ENTRY DATE: 2019-04-01
  ref <313>: RELEVANT RESIDUES IN SEQ ID NO: (1)..(1479)
tcaacttgagagtttgatcctggctcagaacgaacgctggcggcaggcctaacacatgcaagtcgagcgcactctcaaccttcgggcggggagcgagcggcggacgggttagtaacgcgtgggaatgtacccttcactaaggaatagcctctggaaacggagagtaataccttatacgcccttcgggggaaagatttatcggtgaaggatcagcccgcgtaagattagatagttggtggggtaatggcctaccaagtctacgatctttagctggttttagaggatgatcagcaacactgggactgagacacggcccagactcctacgggaggcagcagtggggaatcttggacaatgggcgcaagcctgatccagccatgccgcgtgtgtgatgaaggccttagggtcgtaaagcactttcgctagagatgataatgacagtatctagtaaagaagtcccggctaactccgtgccagcagccgcggtaatacggaggggactagcgttgttcggaattactgggcgtaaagcgtacgtaggcggatcagaaagtatggggtgaaatcccagggctcaaccctggaactgcctcataaactcctggtctagagttcgagagaggtgagtggaattccgagtgtagaggtgaaattcgtagatattcggaggaacaccagtggcgaaggcggctcactggctcgatactgacgctgaggtacgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacggggcccgcacaagcggtggagcatgtggtttaattcgaagcaacgcgcagaaccttaccaacccttgacatcctaggacaacctgagagatcaggccttccttcgggacctagtgacaggtgctgcatggctgtcgtcagctcgtgtcgtgagatgttcggttaagtccggcaacgagcgcaacccacatccttagttgccagcagttcggctgggcactctaaggaaactgcccgtgataagcgggaggaaggtgtggatgacgtcaagtcctcatggcccttacgggttgggctacacacgtgctacaatggcagtgacaatgggttaatcccaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaaggccgtgcgccaacctagcaataggaggcagcggaccacggtgggttcagcgactggggtgaagtcgtaacaaggtagccgtaggggaacctgcggctggatcacctcctttctaa

SEQ ID NO: 8268 - DNA, 1001 bp, Sediminibacillus albus
  ref <308>: DATABASE ACCESSION NUMBER: NCBI ACCESSION: NZ_FNFL01000014.1
  ref <309>: DATABASE ENTRY DATE: 2019-04-01
  ref <313>: RELEVANT RESIDUES IN SEQ ID NO: (1)..(1001)
agcgttgtccggaattattgggcgtaaagcgcgcgcaggcggttccttaagtctgatgtgaaagcccacggcttaaccgtggagggtcattggaaactggggaacttgagtacagaagaggagagcggaattccacgtgtagcggtgaaatgcgtagatatgtggaggaacaccagtggcgaaggcggctctctggtctgtaactgacgctgaggcgcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgatccctctagagatagaggtttcccttcggggacagagtgacaggtggtgcatggttgtcgtcagctcgtgtcgtgagatgttgggttaagtcccgcaacgagcgcaacccttgaccttagttgccagcattcagttgggcactctagggtgactgccggtgacaaaccggaggaaggtggggatgacgtcaaatcatcatgccccttatgacctgggctacacacgtgctacaatggatggtacaaagggacgcgaaaccgcgaggtgaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaacctttttggagccagccgccgaaggtggggccaatgattggggtgaagtcgtaacaaggtagccgtatcggaaggtgcggctggatcacctcctttctaa

SEQ ID NO: 8269 - DNA, 1346 bp, Sediminibacillus halophilus
  ref <308>: DATABASE ACCESSION NUMBER: NCBI ACCESSION: NZ_FNHF01000013.1
  ref <309>: DATABASE ENTRY DATE: 2019-04-01
  ref <313>: RELEVANT RESIDUES IN SEQ ID NO: (1)..(1346)
gcggccttttggctgtcacttacagatgggcccgcggcgcattagctagttggtaaggtaatggcctaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgtcagggaagaacaagtaccgtttgaataaggcggtaccttgacggtacctgacgaggaagccccggctaactacgtgccagcagccgcggtaatacgtagggggcaagcgttgtccggaattattgggcgtaaagcgcgcgcaggcggttccttaagtctgatgtgaaagcccacggcttaaccgtggagggtcattggaaactggggaacttgagtacagaagaggagagcggaattccacgtgtagcggtgaaatgcgtagatatgtggaggaacaccagtggcgaaggcggctctctggtctgtaactgacgctgaggcgcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgacccctctagagatagaggtttcccttcggggacagagtgacaggtggtgcatggttgtcgtcagctcgtgtcgtgagatgttgggttaagtcccgcaacgagcgcaacccttgaccttagttgccagcattcagttgggcactctagggtgactgccggtgacaaaccggaggaaggtggggatgacgtcaaatcatcatgccccttatgacctgggctacacacgtgctacaatggatggtacaaagggaagcgaaaccgcgaggtgaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaacctttttggagccagccgccgaaggtggggccaatgattggggtgaagtcgtaacaaggtagccgtatcggaaggtgcggctggatcacctcctttctaa

SEQ ID NO: 8270 - DNA, 1572 bp, Sediminibacillus massiliensis
  ref <308>: DATABASE ACCESSION NUMBER: NCBI ACCESSION: NZ_LT732535.1
  ref <309>: DATABASE ENTRY DATE: 2019-04-01
  ref <313>: RELEVANT RESIDUES IN SEQ ID NO: (1)..(1572)
tttatggagagtttgatcttggctcaggacgaacgctggcggcgtgcctaatacatgcaagtcgagcgcgggaagcaagtaatcacccttcggggtgtgcgctttgtggaacgagcggcggacgggtgagtaacacgtgggcaacctgcctgtaagactgggataaccccgggaaaccggagctaataccggataacacttttctctgcatggagaagagttgaaaggtggccttttggctgtcacttacagatgggcccgcggcgcattagctagttggtggggtaacggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgttagggaagaacaagtaccgttcaaatagggcggtaccttgacggtacctaacgaggaagccccggctaactacgtgccagcagccgcggtaatacgtagggggcaagcgttgtccggaattattgggcgtaaagcgcgcgcaggcggttccttaagtctgatgtgaaagcccacggcttaaccgtggagggtcattggaaactggggaacttgagtacagaagaggagagcggaattccacgtgtagcggtgaaatgcgtagatatgtggaggaacaccagtggcgaaggcggctctctggtctgtaactgacgctgaggcgcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgccactcttggagacaagaggttcccttcggggacagagtgacaggtggtgcatggttgtcgtcagctcgtgtcgtgagatgttgggttaagtcccgcaacgagcgcaacccttgaccttagttgccagcattcagttgggcactctagggtgactgccggtgacaaaccggaggaaggtggggatgacgtcaaatcatcatgccccttatgacctgggctacacacgtgctacaatggatggtacaaagggaagcgaagccgcgaggtgtagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaaccttttggagccagccgccgaaggtggggccaatgattggggtgaagtcgtaacaaggtagccgtatcggaaggtgcggctggatcacctcctttctaa

SEQ ID NO: 8271 - DNA, 1054 bp, Sediminibacterium ginsengisoli
  ref <308>: DATABASE ACCESSION NUMBER: NCBI ACCESSION: NZ_FUWH01000019.1
  ref <309>: DATABASE ENTRY DATE: 2019-04-01
  ref <313>: RELEVANT RESIDUES IN SEQ ID NO: (1)..(1054)
gtaccctatgaataagcaccggctaactccgtgccagcagccgcggtaatacggagggtgcaagcgttatccggattcactgggtttaaagggtgcgtaggcgggcatttaagtcagtggtgaaatcccagagcttaactctggaactgccattgatactatttgtcttgaatattgtggaggtaagcggaatatgtcatgtagcggtgaaatgcttagatatgacatagaacacctattgcgaaggcagcttactacgcatatattgacgctgaggcacgaaagcgtggggatcaaacaggattagataccctggtagtccacgccctaaacgatggatactcgacatacgcgatacactgtgtgtgtctgagcgaaagcattaagtatcccacctgggaagtacgaccgcaaggttgaaactcaaaggaattggcgggggtccgcacaagcggtggagcatgtggtttaattcgatgatacgcgaggaaccttacctgggctagaatgctatttgaccgtgggtgaaagctcattttgtagcaatacacagatagtaaggtgctgcatggctgtcgtcagctcgtgccgtgaggtgttgggttaagtcccgcaacgagcgcaacccctatcattagttgccaacaggtaaagctgggaactctaatgaaactgccgccgtaaggcgtgaggaaggaggggatgatgtcaagtcatcatggcctttatgcccagggctacacacgtgctacaatgggcaggacaaagggctgcaacacagtgatgtgaagccaatcccaaaaacctgctctcagttcagatcgtagtctgcaactcgactacgtgaagctggaatcgctagtaatcgtatatcagcaatgatacggtgaatacgttcccggaccttgcacacaccgcccgtcaagccatgggagccgggtgtacctaaagtcggtaaccgcaaggatctgcctagggtaaaatcggtgactggggctaagtcgtaacaaggtagccgtaccggaaggtgcggctggaatacctccttttagag

SEQ ID NO: 8272 - DNA, 1469 bp, Sediminimonas qiaohouensis
  ref <308>: DATABASE ACCESSION NUMBER: NCBI ACCESSION: NZ_AUIJ01000005.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcttaacacatgcaagtcgagcgatcccttcggggatagcggcggacgggtgagtaacgcgtgggaacgtgcccttcactacggaatagcccatggaaacgtggattaataccgtatacgccctttgggggaaagaatttcggtgaaggatcggcccgcgtctgattaggtagttggtggggtaatggcctaccaagccgacgatcagtagctggttttagaggatgatcagccacactgggactgagacacggcccagactcctacgggaggcagcagtggggaatcttagacaatgggggcaaccctgatctagccatgccgcgtgagtgatgaaggtcttaggatcgtaaagctctttcgcctgtgatgataatgacagtagcaggtaaagaaaccccggctaactccgtgccagcagccgcggtaatacggagggggttagcgttgttcggaattactgggcgtaaagcgcgcgtaggcggactggaaagttgggggtgaaatcccggggctcaaccccggaactgccttcaaaactatcagtctagagttcgagagaggtgagtggaattgcgagtgtagaggtgaaattcgtagatattcgcaggaacaccagtggcgaaggcggctcactggctcgatactgacgctgaggtgcgaaagtgtggggagcaaacaggattagataccctggtagtccacaccgtaaacgatgaatgccagtcgtcgggttgcatgcaattcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcccgggaccgccagagagatctggtttccacttcggtggctcggtgacaggtgctgcatggctgtcgtcagctcgtgtcgtgagatgttcggttaagtccggcaacgagcgcaacccacgtccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatccccaaaaactgtctcagttcggattggggtctgcaactcgaccccatgaagtcggaatcgctagtaatcgtggaacagcatgccacggtgaatacgttcccgggccttgtacacaccgcccgtcacaccatgggagttgggcctacccgacggccgtgcgctaaccttttcgaaggaggcagcggaccacggtaagctcagcgactggggtgaagtcgtaacaaggtagccgtaggggaacctgcggctggatcacctcctttctaa

SEQ ID NO: 8273 - DNA, 1528 bp, Sediminitomix flava
  ref <308>: DATABASE ACCESSION NUMBER: NCBI ACCESSION: NZ_QGDO01000016.1
  ref <309>: DATABASE ENTRY DATE: 2019-04-01
  ref <313>: RELEVANT RESIDUES IN SEQ ID NO: (1)..(1528)
tacaatggagagtttgatcctggctcaggatgaacgctagcggcaggcttaatacatgcaagtcgaggggtaacaggagagcttgctcttgctgacgaccggcgcacgggtgcgtaacgcgtatgcaacctacctgtaacagggagatagcccagagaaatttggattaatatcccataatatgatttgattgcatgatcgggtcattaaagatttattggttacagatgggcatgcgtcccattagctagttggtaaggtaacggcttaccaaggcgacgatgggtagggggcctgagagggtgatcccccacactggtactgagacacggaccagactcctacgggaggcagcagtagggaatattggtcaatggacgagagtctgaaccagccatgccgcgtgagcgaagaaggccctcgggtcgtaaagctcttttatatgggaagaaaccattctatgcgtaggatgctgacggtaccatacgaataaggaccggctaactccgtgccagcagccgcggtaatacggagggtccgagcgttgtccggaattattgggtttaaagggtgcgtaggcggccttgtaagtcagtggtgaaattttgcggcttaactgtgaaagtgccattgaaactgctaggcttgagtactgtagaggcaggcggaattcctgatgtagcggtgaaatgcatagatatcaggaggaacaccgagagcgaaggcagcttgctggacagtaactgacgctgaggcacgaaagtgtggggagcgaacaggattagataccctggtagtccacaccgtaaacgatgataactaggtgtctgcgatacaatgtaggtgcccaagcgaaagtgataagttatccacctggggagtacgctggcaacagtgaaactcaaaggaattgacgggggtccgcacaagcggtggagcatgtggtttaattcgatgatacgcgaggaaccttacctgggctcgaattcatgtcgacggctttagagatagagctttcttcggacgatatggaaggtgctgcatggctgtcgtcagctcgtgccgtgaggtgttgggttaagtcccgcaacgagcgcaacccctactgttagttgccatcaggttatgctgggcactctagcggaactgcctgcgcaagcagagaggaaggcggggacgacgtcaagtcatcatggcccttacgcccagggcaacacacgtgctacaatggtaaggacaaagagcagccagctggtaacagtgcgcgaatctcaaaaaccttatctcagttcggattgtggtctgcaactcgaccatatgaagctggaatcgctagtaatcgtatatcagctatgatacggtgaatacgttcccggaccttgtacacaccgcccgtcaagccatgggagttgggtgggcctgaagacggtggccgttaaggagctgtcaagggcaaaaccagcgactggggctaagtcgtaacaaggtagccgtaccggaaggtgtggctggaacacctccttttaga

SEQ ID NO: 8274 - DNA, 1325 bp, Seinonella peptonophila
  ref <308>: DATABASE ACCESSION NUMBER: NCBI ACCESSION: NZ_FQVL01000036.1
  ref <309>: DATABASE ENTRY DATE: 2019-04-01
  ref <313>: RELEVANT RESIDUES IN SEQ ID NO: (1)..(1325)
ggatgggcccgcggcgcattagctagtaggtgaggtaaaggctcacctaggcaacgatgcgtagccgacctgagagggtgatcggccacactgggactgagacacggcccagactcctacgggaggcagcagtagggaattttccgcaatgggcgaaagcctgacggagcaacgccgcgtgagtgaggacggtcttcggattgtaaagctctgttctgtaggaagaagtcctcgtgttgaatagatacgaggggtgacgttactacagcagaaagccccggctaactacgtgccagcagccgcggtaatacgtagggggcaagcgttgtccggaatcattgggcgtaaagcgcgcgtaggcggcttcataagtccgatgtcaaaggcagtggctcaaccactgtacgcatcggaaactgtggagcttgagtgcaggagaggggagtggaattctcggtgtagcggtggaatgcgtagagatcgggaggaacaccagtggcgaaggcgactctctggcctgtaactgacgctgaggtgcgaaagcgtggggagcgaacaggattagataccctggtagtccacgccgtaaacgatgagtgctaggtgttggggggtttccacccctcagtgccgaagttaacacattaagcactccgcctggggagtacgaccgcaaggttgaaactcaaaggaattgacgggggcccgcacaagcggtggagcatgtggtttaattcgaagcaacgcgaagaaccttaccagggcttgacatcccgctgacagatctagagatagatcctttcttcggaacagcggtgacaggtggtgcatggttgtcgtcagctcgtgtcgtgagatgttgggttcagtcccgcaacgagcgcaacccttatctttagttgccagcaggtaatgctgggcactctagagagacagccgatgaaagtcggaggaaggtggggatgacgtcaaatcatcatgccccttatgtcctgggctacacacgtgctacaatggctggaacaatgggaagcgagaccgcgaggtggagccaatcccaaaaaaccagtctcagttcggatcgcaggctgcaactcgcctgcgtgaagttggaatcgctagtaatcgcggatcagcatgccgcggtgaatacgttcccgggccttgtacacaccgcccgtcacaccacgggagtttgcaacacccgaagtcggtgagagaaccgttaggactcagctgccgaaggtggggtagatgactggggtgaagtcgtaacaaggtatccctaccggaaggtggggatggatcacctcctttctatggag

SEQ ID NO: 8275 - DNA, 1054 bp, Selenihalanaerobacter shriftii
  ref <308>: DATABASE ACCESSION NUMBER: NCBI ACCESSION: NZ_FUWM01000054.1
  ref <309>: DATABASE ENTRY DATE: 2019-04-01
  ref <313>: RELEVANT RESIDUES IN SEQ ID NO: (1)..(1054)
tctgtcctcagggaagaacaccctagtcgtaaataacggctaggtttgacggtacctgtggaggaagctccggctaactacgtgccagcagccgcggtaatacgtagggagcaagcgttgtccggaattattgggcgtaaagggtgtgtaggcggtctagtaagtcaaatgtgaaattcatcggctcaaccgatgaactgcctttgaaactactagacttgagggtaagagaagagagtagaattcctagtgtagcggtgaaatgcgtagatattaggaagaataccagtggcgaaagcgactctctggcttactcctgacgctgagacacgaaagctagggtatcaaaccggattagatacccgggtagtcctagccgtaaacgctggatactaggtgttggaggttcgactccttcggtgccgaagttaacgcaataagtatcccgcctggggattacgaccgcaaggttgaaactcaaaggaattgacgggggcccgcacaagcggcggagcatgtggtttaattcgaagcaacgcgaagaaccttaccagggtttgacatcccgtgaccacctatgaaagtaggatttgatcttttgatcacacggagacaggtggtgcatggctgtcgtcagctcgtgtcgtgagatgttgggttaagtcccgcaacgagcgcaacccttattcttagttgccagcacttttaggtggggactctaaggagactgccagtcaaaaaactggaggaaggtggggatgacgtcaagtcatcatgccccttatactctgggctacacacgtgctacaatggactgtacagagggtcgctacaccgcaaggtgatgctaatctctaaaacagttcccagttcggattgcaggctgcaactcgcctgcatgaagttggagtcgctagtaatcgtggatcagaatgccgcggtgaatacgttcccgggccttgtacacaccgcccgtcacaccacccgagttggatgcaccagaagtcatcataccgtttaaggtagatgccgaaggtgtgtctggtaagggggg

SEQ ID NO: 8276 - DNA, 1216 bp, Selenomonas flueggei
  ref <308>: DATABASE ACCESSION NUMBER: NCBI ACCESSION: NZ_GG694009.1
  ref <309>: DATABASE ENTRY DATE: 2019-04-01
  ref <313>: RELEVANT RESIDUES IN SEQ ID NO: (1)..(1216)
gatgggtctgcgtctgattagctggtaggtgaggtaacggctcacctaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgacggggacgaacgtgcgtgatgcgaacagtgtcatgcaatgacggtacctgtcgaggaagccacggctaactacgtgccagcagccgcggtaatacgtaggtggcgagcgttgtccggaatcattgggcgtaaagggagcgcaggcgggcaagtaagtctttcttaaaagtgcggggctcaaccccgtgatgggaaagaaactacatgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggccgcaaggctgaaactcaaaggaattgacggggacccgcacaagcggtggagtatgtggtttaattcgaagcaacgcgaagaaccttaccaggccttgacattgactgaaagagctagagatagctccctctcttcggagacaggaaaacaggtggtgcatggctgtcgtcagctcgtgtcgtgagatgttgggttaagtcccgcaacgagcgcaacccctgttctttgttgccatcacgtaaaggtgggcactcaaaggagactgccgcggagaacgcggaggaaggcggggatgacgtcaagtcatcatgccccttatggtctgggctacacacgtactacaatggaacggacagagagcagcgaacccgcgagggcaagcgaacctcaaaaaccgtttcccagttcggattgcaggctgcaacccgcctgcatgaagtcggaatcgctagtaatcgcaggtcagcatactgcggtgaatacgttcccgggtcttgtacacaccgcccgtcacaccacggaagtcattcacacccgaagccggc

SEQ ID NO: 8277 - DNA, 1551 bp, Selenomonas infelix
  ref <308>: DATABASE ACCESSION NUMBER: NCBI ACCESSION: NZ_JH376803.1
  ref <309>: DATABASE ENTRY DATE: 2019-04-01
  ref <313>: RELEVANT RESIDUES IN SEQ ID NO: (1)..(1551)
ttagcggagagtttgatcctggctcaggacgaacgctggcggcgtgcttaacacatgcaagtcgaacggagcgaatgaaagcttgcttttatgagcttagtggcaaacgggtgagtaacacgtagacaacctgccgacaggatggggacaacattccgaaaggaatgctaataccgaatgaagcggaggagaggcatctctcctccgtgaaagatggcctctatttataagctatcacctgtcgatgggtctgcgtctgattagctagttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgatggggacgaacgtgcgaagggtgaataatcctttgcaatgacggtacctatcgaggaagccacggctaactacgtgccagcagccgcggtaatacgtaggtggcgagcgttgtccggaatcattgggcgtaaagggagcgcaggcgggcaagtaagtctttcttaaaagttcggggctcaaccccgtgatgggaaagaaactacatgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggccttgacattgactgtaagagctagagatagctccctctcttcggagacaggaaaacaggtggtgcatggctgtcgtcagctcgtgtcgtgagatgttgggttaagtcccgcaacgagcgcaacccctgttctttgttgccatcacgtaaaggtgggcactcaaaggagactgccgcggagaacgcggaggaaggcggggatgacgtcaagtcatcatgccccttatggtctgggctacacacgtactacaatggaacggacagagagcagcgaacccgcgagggcaagcgaacctcaaaaaccgtttcccagttcggattgcaggctgcaactcgcctgcatgaagtcggaatcgctagtaatcgcaggtcagcatactgcggtgaatacgttcccgggtcttgtacacaccgcccgtcacaccacggaagtcgttcacacccgaagccggcgcagccgtctaaggtggggaaggtgactggggtgaagtcgtaacaaggtagccgtatcggaaggtgcggctggatcacctcctttctaagga

SEQ ID NO: 8278 - DNA, 1548 bp, Selenomonas massiliensis
  ref <308>: DATABASE ACCESSION NUMBER: NCBI ACCESSION: NZ_LT985754.1
  ref <309>: DATABASE ENTRY DATE: 2019-04-01
  ref <313>: RELEVANT RESIDUES IN SEQ ID NO: (1)..(1548)
attagcggagagtttgatcctggctcaggacgaacgctggcggcgtgcttaacacatgcaagtcgaacgggatgatttagaagcttgcttttagagaatctagtggcaaacgggtgagtaacacgtagacaacctgccgacaggatggggacaacattccgaaaggaatgctaataccgaatgaagcggaggagaggcatctctcttccgtgaaagatggcctctgaatatgctatcacctgtcgatgggtctgcgtctgattagctagttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgatggggacgaacgtacggagtgcaaatagtgctctgtaatgacggtacctatcgaggaagccacggctaactacgtgccagcagccgcggtaatacgtaggtggcgagcgttgtccggaatcattgggcgtaaagggagcgcaggcgggcatgtaagtctttcttaaaagtgcggggctcaaccccgtgatgggaaagaaactatatgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggccttgacattgactgaaagtgctagagatagcaccctctcttcggagacaggaaaacaggtggtgcatggctgtcgtcagctcgtgtcgtgagatgttgggttaagtcccgcaacgagcgcaacccctgttctttgttgccatcacgtaaaggtgggcactcaaaggagactgccgcggagaacgcggaggaaggcggggatgacgtcaagtcatcatgccccttatggtctgggctacacacgtactacaatggaacggacagagagcagcgaacccgcgagggcaagcgaacctcaaaaaccgtttcccagttcggattgcaggctgcaactcgcctgcatgaagtcggaatcgctagtaatcgcaggtcagcatactgcggtgaatacgttcccgggtcttgtacacaccgcccgtcacaccacggaagtcgttcacacccgaagccggcgcagccgtctaaggtggggaaggtgactggggtgaagtcgtaacaaggtagccgtatcggaaggtgcggctggatcacctcctttcta

SEQ ID NO: 8279 - DNA, 1549 bp, Selenomonas noxia
  ref <308>: DATABASE ACCESSION NUMBER: NCBI ACCESSION: NZ_JH376859.1
  ref <309>: DATABASE ENTRY DATE: 2019-04-01
  ref <313>: RELEVANT RESIDUES IN SEQ ID NO: (1)..(1549)
ttcgcggagagtttgatcctggctcaggacgaacgctggcggcgtgcttaacacatgcaagtcgaacggagcgaatgaaagcttgcttttataagcttagtggcaaacgggtgagtaacacgtagacaacctgccgacaggatggggacaacattccgaaaggaatgctaataccgaatgaagtgcaggggaggcatctcccctgcatgaaagatggcctctttttatgctatcacctgttgatgggtctgcgtctgattagctagttggtgaggtaacggctcacctaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgatggggacgaacgtgcctaatgcgaatagttttaggtaatgacggtacccatcgaggaagccacggctaactacgtgccagcagccgcggtaatacgtaggtggctagcgttgtccggaatcattgggcgtaaagggagcgcaggcgggcatgtaagtctttcttaaaagtgcggggctcaaccccgtgatgggaaagaaactatgtgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggccgcaaggctgaaactcaaaggaattgacggggacccgcacaagcggtggagtatgtggtttaattcgaagcaacgcgaagaaccttaccaggccttgacattgactgaaagagctagagatagctccctctcttcggagacaggaaaacaggtggtgcatggctgtcgtcagctcgtgtcgtgagatgttgggttaagtcccgcaacgagcgcaacccctgttctttgttgccagcatgtaaggatgggcactcaaaggagactgccgcggagaacgcggaggaaggcggggatgacgtcaagtcatcatgccccttatggtctgggctacacacgtactacaatgggacggacagagggcagcgagagagtgatcttaagcgaatctcaaaaaccgtttctcagttcggattgcaggctgcaactcgcctgcatgaagtcggaatcgctagtaatcgcaggtcagcatactgcggtgaatacgttcccgggtcttgtacacaccgcccgtcacaccacggaagtcattcacacccgaagccggctaggccgtctaaggtggggaaggtgactggggtgaagtcgtaacaaggtagccgtatcggaaggtgcggctggatcacctcctttctaagga

SEQ ID NO: 8280 - DNA, 1472 bp, Selenomonas ruminantium
  ref <308>: DATABASE ACCESSION NUMBER: NCBI ACCESSION: NZ_FRBC01000059.1
  ref <309>: DATABASE ENTRY DATE: 2019-04-01
  ref <313>: RELEVANT RESIDUES IN SEQ ID NO: (1)..(1472)
cgagtggcaaacgggtgagtaacgcgtagacaacctgccgcaaagatggggacaacagttcgaaaggactgctaataccgaatgttgtcagattcccgcatgggagactgattaaagatggcctctacttgtaagctatcgctttgcgatgggtctgcgtctgattagctagttggtggggtaacggcctaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagaagggtttcggctcgtaaagctctgttgacggggacgaatgtgctagatgcgaatagtttctagcaatgacggtacccgtcgaggaagccacggctaactacgtgccagcagccgcggtaatacgtaggtggcgagcgttgtccggaattattgggcgtaaagggagcgcaggcgggaaggcaagtcagtcttaaaagtgcggggctcaaccccgtgatgggattgaaactgtctttcttgagtgcaggagaggaaagcggaattcctagtgtagcggtgaaatgcgtagatattaggaggaacaccagtggcgaaggcggctttctggactgtaactgacgctgaggctcgaaagcgtggggagcgaacaggattagataccctggtagtccacgccgtaaacgatgaatgctaggtgtaggaggtatcgaccccttctgtgccggagttaacgcaataagcattccgcctggggagtacggtcgcaagactgaaactcaaaggaattgacgggggcccgcacaagcggtggagtatgtggtttaattcgacgcaacgcgaagaaccttaccagggcttgacattgagtgaaagacctagagataggtccctctcttcggagacacgaaaacaggtggtgcatggctgtcgtcagctcgtgtcgtgagatgttgggttaagtcccgcaacgagcgcaacccctatcatttgttgccagcacgtcaaggtgggaactcaaatgagactgccgcggacaacgcggaggaaggcggggatgacgtcaagtcatcatgccccttatgtcctgggctacacacgtactacaatgggatggacagagagcagcgaacccgcgagggcaagcgaaccccataaaccatctcccagttcggattgcaggctgcaacccgcctgcatgaagtcggaatcgctagtaatcgctggtcagcatacagcggtgaatacgttcccgggccttgtacacaccgcccgtcacaccacggaagtcattcacacccgaagccggtgggcaaaccgcaaggatgcagccgtctaaggtgggggcgatgactggggtgaagtcgtaacaaggtagccgtatcggaaggtgcggctggatcacctcctttctaagga

SEQ ID NO: 8281 - DNA, 1037 bp, Selenomonas sp. CM52
  ref <308>: DATABASE ACCESSION NUMBER: NCBI ACCESSION: NZ_ALNM01000027.1
  ref <309>: DATABASE ENTRY DATE: 2019-04-01
  ref <313>: RELEVANT RESIDUES IN SEQ ID NO: (1)..(1037)
tttttcggagagtttgatcctggctcaggacgaacgctggcggcgtgcttaacacatgcaagtcgaacgggaacctttatttcggtaaaggtgagagtggcaaacgggtgagtaacacgtaggcaacctgccgacaggatggggacaacattccgaaaggaatgctaataccgaatgaagtcaccggagggcatcctctggtgatgaaagatggcctctgaatatgctatcacctgtcgatgggcctgcgtctgattagccagttggcggggtaacggcccaccaaagcgacgatcagtagccggtctgagaggatgaacggccacattgggactgagacacggcccagactcctacgggaggcagcagtggggaatcttccacaatgggcgaaagcctgatggagcaacgccgcgtgagtgaagaaggtcttcggatcgtaaagctctgttgcacgggacgaaaaccgagcttgaaaacattgagtttgggtgacggtaccgagcgaggaagccacggctaactacgtgccagcagccgcggtaatacgtaggtggcgagcgttgtccggaattattgggcgtaaagggagcgcaggcggacatataagtccatcttaaaagtgcggggctcaaccccgtgaggggatggaaactgtatgccttgagtgcaggagaggaaagcggaattcccagtgtagcggtgaaatgcgtagatattgggaggaacaccagtggcgaaggcggctttctggactgtaactgacgctgaggctcgaaagccaggggagcgaacgggattagataccccggtagtcctggccgtaaacgatgaatgctaggtgtaggaggtatcgacccctcctgtgccggagttaacgcaataagcattccgcctggggagtacggtcgcaagactgaaactcaaaggaattgacgggggcccgcacaagcggtggagtatgtggtttaattcgacgcaacgcgaagaaccttaccagggcttgacattgagtgaaagagctagagatagctccc

SEQ ID NO: 8282 - DNA, 1551 bp, Selenomonas sp. F0473
  ref <308>: DATABASE ACCESSION NUMBER: NCBI ACCESSION: NZ_JH992903.1
  ref <309>: DATABASE ENTRY DATE: 2019-04-01
  ref <313>: RELEVANT RESIDUES IN SEQ ID NO: (1)..(1551)
ttttacggagagtttgatcctggctcaggacgaacgctggcggcgtgcttaacacatgcaagtcgaacggagcgaatgaaagcttgcttttataagcttagtggcaaacgggtgagtaacacgtagacaacctgccgatcagatggggacaacattccgaaaggaatgctaataccgaatggtgtgcgggggaggcatctcccccgcatgaaagatggccaatacatgtaagctatcactgatcgatgggtctgcgtctgattagctggtaggtaaggtaacggcttacctaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgaaggggacgaacgtgtatagtgcaaatagtgctatataatgacggtaccttttgaggaagccacggctaactacgtgccagcagccgcggtaatacgtaggtggcgagcgttgtccggaatcattgggcgtaaagggagcgcaggcggccgtgtaagtcttgcttaaaagttcggggctcaaccccgtgatgggcaagaaactatatggcttgagtgcaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccgggccttgacattgattgacagagatagagatatctccttctcttcggagacaagaaaacaggtggtgcatggctgtcgtcagctcgtgtcgtgagatgttgggttaagtcccgcaacgagcgcaacccctgtcctttgttgccagcaagtgaagttgggcactcaaaggagactgccgcggagaacgcggaggaaggcggggatgacgtcaagtcatcatgccccttatggtccgggctacacacgtactacaatgggacggacagagagcagcgagagggcgaccttaagcgaacctcaaaaaccgtttctcagttcggattgcaggctgcaactcgcctgcatgaagtcggaatcgctagtaatcgcaggtcagcatactgcggtgaatacgttcccgggtcttgtacacaccgcccgtcacaccacggaagtcgttcacacccgaagccggctaggccgtctaaggtggggaaggtgactggggtgaagtcgtaacaaggtagccgtatcggaaggtgcggctggatcacctcctttctaagg

SEQ ID NO: 8283 - DNA, 495 bp, Selenomonas sp. FC4001
  ref <308>: DATABASE ACCESSION NUMBER: NCBI ACCESSION: NZ_JNJF01000021.1
  ref <309>: DATABASE ENTRY DATE: 2019-04-01
  ref <313>: RELEVANT RESIDUES IN SEQ ID NO: (1)..(495)
ttttatggagagtttgatcctggctcaggacgaacgctggcggcgtgcttaacacatgcaagtcgaacgagacgattttaagcttgcttagaaaagtcgagtggcaaacgggtgagtaacgcgtagacaacctgccgcaaagatggggacaacagtccgaaaggactgctaataccgaatgttgtcagattcccgcatgggagactgattaaagatggcctctacttgtaagctatcgctttgcgatgggtctgcgtctgattagctagttggtggggtaacggcctaccaaggcgacgatcagtagccggtctgagaggatgaacggccacattggaactgagacacggtccagactcctacgggaggcagcagtggggaatcttccgcaatgggcgaaagcctgacggagcaacgccgcgtgagtgaagaagggtttcggctcgtaaagctctgttgacggggacgaacgtgcgagatgcgaatagtttcttg

SEQ ID NO: 8284 - DNA, 1546 bp, Selenomonas sp. FOBRC6
  ref <308>: DATABASE ACCESSION NUMBER: NCBI ACCESSION: NZ_ALKG01000041.1
  ref <309>: DATABASE ENTRY DATE: 2019-04-01
  ref <313>: RELEVANT RESIDUES IN SEQ ID NO: (1)..(1546)
ttagcggagagtttgatcctggctcaggacgaacgctggcggcgtgcttaacacatgcaagtcgaacggagcgaatgaaagcttgcttttatgagcttagtggcaaacgggtgagtaacacgtagacaacctgccgacaggatggggacaacattccgaaaggaatgctaataccgaatgaagcggaggagaggcatctctcttccgtgaaagatggcctctgaacatgctatcacctgtcgatgggtctgcgtctgattagctagttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgacggggacgaacgtgcgagaggtgaataatctcttgcaatgacggtacctgtcgaggaagccacggctaactacgtgccagcagccgcggtaatacgtaggtggcgagcgttgtccggaatcattgggcgtaaagggagcgcaggcgggcatgtaagtctttcttaaaagttcggggctcaaccccgtgatgggaaagaaactacatgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggccttgacattgactgaaagatgctagagatagcatcctctcttcggagacaggaaaacaggtggtgcatggctgtcgtcagctcgtgtcgtgagatgttgggttaagtcccgcaacgagcgcaacccctgttctttgttgccatcacgttatggtgggcactcaaaggagactgccgcggagaacgcggaggaaggcggggatgacgtcaagtcatcatgccccttatggtctgggctacacacgtactacaatggaacggacagagagcagcgaacccgcgagggcaagcgaacctcaaaaaccgtttcccagttcggattgcaggctgcaactcgcctgcatgaagtcggaatcgctagtaatcgcaggtcagcatactgcggtgaatacgttcccgggtcttgtacacaccgcccgtcacaccacggaagtcgttcacacccgaagccggcgcagccgtctaaggtggggaaggtgactggggtgaagtcgtaacaaggtagccgtatcggaaggtgcggctggatcacctcctttcta

SEQ ID NO: 8285 - DNA, 286 bp, Selenomonas sp. FOBRC9
  ref <308>: DATABASE ACCESSION NUMBER: NCBI ACCESSION: NZ_ALJR01000020.1
  ref <309>: DATABASE ENTRY DATE: 2019-04-01
  ref <313>: RELEVANT RESIDUES IN SEQ ID NO: (1)..(286)
tcttttacggagagtttgatcctggctcaggacgaacgctggcggcgtgcttaacacatgcaagtcgaacggagcgaatgaaagcttgcttttatgagcttagtggcaaacgggtgagtaacacgtagacaccctgccgatcagatggggacaacattccgaaaggaatgctaataccgaatggcgtgtaggggaggcatctccccctatatgaaagatggcctctatatataagctatcactgatcgatgggtctgcgtctgattagctagtaggtaaggtaacg

SEQ ID NO: 8286 - DNA, 1847 bp, Selenomonas sp. Marseille-P3560
  misc_feature (1459)..(1459): n is a, c, g, or t
  ref <308>: DATABASE ACCESSION NUMBER: NCBI ACCESSION: NZ_LT891955.1
  ref <309>: DATABASE ENTRY DATE: 2019-04-01
  ref <313>: RELEVANT RESIDUES IN SEQ ID NO: (1)..(1847)
tagtggcaaacgggtgagtaacacgtagacaacctgccgacaggatggggacaacattccgaaaggaatgctaataccgaatgaagtcagaggagggcatcctcctctgatgaaagatggcctctatttataagctatcacctgttgatgggtctgcgtctgattagctagttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgacggggacgaacgtgcctagtgcaaatagtattaggtaatgacggtacctgtcgaggaagccacggctaactacgtgccagcagccgcggtaatacgtaggtggcgagcgttgtccggaatcattgggcgtaaagggagcgcaggcgggccggtaagtcttacttaaaagtgcggggctcaaccccgtgatgggagagaaactatcggtcttgagtacaggagaggaaagcggaattcccagtgtagcggtgaaatgcgtagatattgggaagaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggccgcaaggctgaaactcaaaggaattgacggggacccgcacaagcggtggagtatgtggtttaattcgaagcaacgcgaagaaccttaccaggccttgacattgactgaaagtgctagagatagcaccctctcttcggagacaggaaaacaggtggtgcatggctgtcgtcagctcgtgtcgtgagatgttgggttaagtcccgcaacgagcgcaacccctgttctttgttgccatcaggtaaagctgggcactcaaaggagactgccgcggagaacgcggaggaaggcggggatgacgtcaagtcatcatgccccttatggcctgggctacacacgtactacaatggaacggacagagagcagcgaacccgcgagggcaagcgaacctcaaaaaccgtttcccagttcggattgcaggctgcaacccgcctgcatgaagtcggaatcgctagtaatcgcaggtcagcatactgcggtgaatacgttcccgggtcttgtacacaccgcccgtcacaccacggaagtcattcacacccgaagccggcgcagccgtctaaggtggggaaggtgactggggtgaagtcgtaacaaggtagccgtatcggaaggtgcggctggatcacctcctttctaaggataagntgggcactcaaaggagactgccgcggagaacgcggaggaaggcggggatgacgtcaagtcatcatgccccttatggcctgggctacacacgtactacaatggaacggacagagagcagcgaacccgcgagggcaagcgaacctcaaaaaccgtttcccagttcggattgcaggctgcaacccgcctgcatgaagtcggaatcgctagtaatcgcaggtcagcatactgcggtgaatacgttcccgggtcttgtacacaccgcccgtcacaccacggaagtcattcacacccgaagccggcgcagccgtctaaggtggggaaggtgactggggtgaagtcgtaacaaggtagccgtatcggaaggtgcggctggatcacctcctttcta

SEQ ID NO: 8287 - DNA, 1507 bp, Selenomonas sp. oral taxon 126
  ref <308>: DATABASE ACCESSION NUMBER: NCBI ACCESSION: NZ_CP016201.1
  ref <309>: DATABASE ENTRY DATE: 2019-04-01
  ref <313>: RELEVANT RESIDUES IN SEQ ID NO: (1)..(1507)
gcttaacacatgcaagtcgaacgggataatttgagagcttgctcttagagaatctagtggcaaacgggtgagtaacacgtagacaacctgccgacaggatggggacaacattccgaaaggaatgctaataccgaatgaagtcgagggagggcatcctctctcgatgaaagatggcctctttttatgctatcacctgtcgatgggtctgcgtctgattagctggttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgatggggacgaacgtgcgaagggtgaataatcctttgtaatgacggtacctgtcgaggaagccacggctaactacgtgccagcagccgcggtaatacgtaggtggcgagcgttgtccggaatcattgggcgtaaagggagcgcaggcgggcatgtaagtctttcttaaaagttcggggctcaaccccgtgatgggaaagaaactacatgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggccttgacattgactgaaagactcagagatgagttcctctcttcggagacaggaaaacaggtggtgcatggctgtcgtcagctcgtgtcgtgagatgttgggttaagtcccgcaacgagcgcaacccctgttcctttgttgccagcgcgtaatggtgggcactcaaaggagactgccgcggagaacgcggaggaaggcggggatgacgtcaagtcatcatgccccttatggtctgggctacacacgtactacaatggaacggacagagagcagcgaacccgcgagggcaagcgaacctcaaaaaccgtttcccagttcggattgcaggctgcaactcgcctgcatgaagtcggaatcgctagtaatcgcaggtcagcatactgcggtgaatacgttcccgggtcttgtacacaccgcccgtcacaccacggaagtcgttcacacccgaagccggcgcagccgtctaaggtggggaaggtgactggggtgaagtcgtaacaaggtagccgtatcggaaggtgcggctggatcacctcctttctaagga

SEQ ID NO: 8288 - DNA, 1646 bp, Selenomonas sp. oral taxon 136
  ref <308>: DATABASE ACCESSION NUMBER: NCBI ACCESSION: NZ_CP014239.1
  ref <309>: DATABASE ENTRY DATE: 2019-04-01
  ref <313>: RELEVANT RESIDUES IN SEQ ID NO: (1)..(1646)
ttttatggagagtttgatcctggctcaggacgaacgctggcggcgtgcttaacacatgcaagtcgaacgaaattaaaaaattatcattgagctctccgatgagatgggagccaagcgtcgtgaccgcggagcgggcaccacgcgttcaacaagtgcaacaccaagtcgaagggttgaatggtaattttttaatttagtggcaaacgggtgagtaacacgtagacaacctgccgacaggatggggacaacattccgaaaggaatgctaataccgaatgaagtcagaggagggcatccttctctgatgaaagatggcctctttttatgctatcacctgttgatgggtctgcgtctgattagctggttggtgaggtaacagctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgacggggacgaacgtgcggggtgcgaatagcactttgtaatgacggtacctgtcgaggaagccacggctaactacgtgccagcagccgcggtaatacgtaggtggcgagcgttgtccggaatcattgggcgtaaagggagcgcaggcgggccggtaagtcttacttaaaagtgcggggctcaaccccgtgatgggagagaaactatcggtcttgagtacaggagaggaaagcggaattcccagtgtagcggtgaaatgcgtagatattgggaagaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggccgcaaggctgaaactcaaaggaattgacggggacccgcacaagcggtggagtatgtggtttaattcgaagcaacgcgaagaaccttaccaggccttgacattgactgaaagagttagagataactccctctcttcggagacaggaaaacaggtggtgcatggctgtcgtcagctcgtgtcgtgagatgttgggttaagtcccgcaacgagcgcaacccctgttctttgttgccatcaggtaaagctgggcactcaaaggagactgccgcggagaacgcggaggaaggcggggatgacgtcaagtcatcatgccccttatggcctgggctacacacgtactacaatggaacggacagagagcagcgaacccgcgagggcaagcgaacctcaaaaaccgtttcccagttcggattgcaggctgcaacccgcctgcatgaagtcggaatcgctagtaatcgcaggtcagcatactgcggtgaatacgttcccgggtcttgtacacaccgcccgtcacaccacggaagtcattcacacccgaagccggcgcagccgtctaaggtggggaaggtgactggggtgaagtcgtaacaaggtagccgtatcggaaggtgcggctggatcacctcctttctaagga

SEQ ID NO: 8289 - DNA, 1552 bp, Selenomonas sp. oral taxon 137
  ref <308>: DATABASE ACCESSION NUMBER: NCBI ACCESSION: NZ_AENV01000007.1
  ref <309>: DATABASE ENTRY DATE: 2019-04-01
  ref <313>: RELEVANT RESIDUES IN SEQ ID NO: (1)..(1552)
ttttacggagagtttgatcctggctcaggacgaacgctggcggcgtgcttaacacatgcaagtcgaacggagcgaatgaaagcttgcttttatgagcttagtggcaaacgggtgagtaacacgtagacaacctgccgatcagatggggacaacattccgaaaggaatgctaataccgaatggcgtgtggggaggcatcttccctacatgaaagatggcctctatttataagctatcactgatcgatgggtctgcgtctgattagctagtaggtaaggtaacggcttacctaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgaagggggcgaacgtacgcagtgcgaatagtgctgagtaatgacggtaccttttgaggaagccacggctaactacgtgccagcagccgcggtaatacgtaggtggcgagcgttgtccggaatcattgggcgtaaagggagcgcaggcggccatgtaagtcttgcttaaaagttcggggctcaaccccgtgatgggcaagaaactatatggcttgagtgcaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggtcttgacattgattgacagggatagagatatcctattctctttggagacaagaaaacaggtggtgcatggctgtcgtcagctcgtgtcgtgagatgttgggttaagtcccgcaacgagcgcaacccctgtcctttgttgccagcatgtagtggtgggcactcaaaggagactgccgcggagaacgcggaggaaggcggggatgacgtcaagtcatcatgccccttatgacctgggctacacacgtactacaatgggacggacagagagcagcgagagggcgaccttaagcgaacctcaaaaaaccgtttctcagttcggattgcaggctgcaactcgcctgcatgaagtcggaatcgctagtaatcgcaggtcagcatactgcggtgaatacgttcccgggtcttgtacacaccgcccgtcacaccacggaagtcgttcacacccgaagccggcgcagccgtctaaggtggggaaggtgactggggtgaagtcgtaacaaggtagccgtatcggaaggtgcggctggatcacctcctttctaagga

SEQ ID NO: 8290 - DNA, 543 bp, Selenomonas sp. oral taxon 138
  ref <308>: DATABASE ACCESSION NUMBER: NCBI ACCESSION: NZ_KB290956.1
  ref <309>: DATABASE ENTRY DATE: 2019-04-01
  ref <313>: RELEVANT RESIDUES IN SEQ ID NO: (1)..(543)
gaatagtgctctgtaatgacggtacctgtcgaggaagccacggctaactacgtgccagcagccgcggtaatacgtaggtggcgagcgttgtccggaatcattgggcgtaaagggagcgcaggcgggcatgtaagtctttcttaaaagtgcggggctcaaccccgtgatgggaaagaaactacatgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggccttgacattgactgaaa

SEQ ID NO: 8291 - DNA, 1270 bp, Selenomonas sp. oral taxon 149
  ref <308>: DATABASE ACCESSION NUMBER: NCBI ACCESSION: NZ_GL397091.1
  ref <309>: DATABASE ENTRY DATE: 2019-04-01
  ref <313>: RELEVANT RESIDUES IN SEQ ID NO: (1)..(1270)
ggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgacggggacgaacgtgcggagtgcgaatagcgctttgtaatgacggtacctgtcgaggaagccacggctaactacgtgccagcagccgcggtaatacgtaggtggcgagcgttgtccggaatcattgggcgtaaagggagcgcaggcgggccggtaagtcttacttaaaagtgcggggctcaaccccgtgatgggagagaaactatcggtcttgagtacaggagaggaaagcggaattcccagtgtagcggtgaaatgcgtagatattgggaagaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggccgcaaggctgaaactcaaaggaattgacggggacccgcacaagcggtggagtatgtggtttaattcgaagcaacgcgaagaaccttaccaggccttgacattgactgaaagagctagagatagcaccctctcttcggagacaggaaaacaggtggtgcatggctgtcgtcagctcgtgtcgtgagatgttgggttaagtcccgcaacgagcgcaacccctgttctttgttgccatcaggtaaagctgggcactcaaaggagactgccgcggagaacgcggaggaaggcggggatgacgtcaagtcatcatgccccttatggcctgggctacacacgtactacaatggaacggacagagagcagcgaacccgcgagggcaagcgaacctcaaaaaccgtttcccagttcggattgcaggctgcaacccgcctgcatgaagtcggaatcgctagtaatcgcaggtcagcatactgcggtgaatacgttcccgggtcttgtacacaccgcccgtcacaccacggaagtcattcacacccgaagccggcgcagccgtctaaggtggggaaggtgactggggtgaagtcgtaacaaggtagccgtatcggaaggtgcggctggatcacctcctttctaagga

SEQ ID NO: 8292 - DNA, 1554 bp, Selenomonas sp. oral taxon 478
  ref <308>: DATABASE ACCESSION NUMBER: NCBI ACCESSION: NZ_CP012071.1
  ref <309>: DATABASE ENTRY DATE: 2019-04-01
  ref <313>: RELEVANT RESIDUES IN SEQ ID NO: (1)..(1554)
ttttatggagagtttgatcctggctcaggacgaacgctggcggcgtgcttaacacatgcaagtcgaacgggatgatcttaaagcttgcttttagagaatctagtggcaaacgggtgagtaacacgtagacaacctgccgacaggatggggacaacattccgaaaggaatgctaataccgaatgaagtcagaggagggcatcctcctctgatgaaagatggcctctatttataagctatcacctgttgatgggtctgcgtctgattagctagttggtgaggtaacggctcaccaaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgacggggacgaacgtgcggagtgcgaatagcgctttgtaatgacggtacctgtcgaggaagccacggctaactacgtgccagcagccgcggtaatacgtaggtggcgagcgttgtccggaatcattgggcgtaaagggagcgcaggcgggccggtaagtcttacttaaaagtgcggggctcaaccccgtgatgggagagaaactatcggtcttgagtacaggagaggaaagcggaattcccagtgtagcggtgaaatgcgtagatattgggaagaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggccgcaaggctgaaactcaaaggaattgacggggacccgcacaagcggtggagtatgtggtttaattcgaagcaacgcgaagaaccttaccaggccttgacattgactgaaagtgctagagatagcaccctctcttcggagacaggaaaacaggtggtgcatggctgtcgtcagctcgtgtcgtgagatgttgggttaagtcccgcaacgagcgcaacccctgttctttgttgccatcaggtaaagctgggcactcaaaggagactgccgcggagaacgcggaggaaggcggggatgacgtcaagtcatcatgccccttatggcctgggctacacacgtactacaatggaacggacagagagcagcgaacccgcgagggcaagcgaacctcaaaaaccgtttcccagttcggattgcaggctgcaacccgcctgcatgaagtcggaatcgctagtaatcgcaggtcagcatactgcggtgaatacgttcccgggtcttgtacacaccgcccgtcacaccacggaagtcattcacacccgaagccggcgcagccgtctaaggtggggaaggtgactggggtgaagtcgtaacaaggtagccgtatcggaaggtgcggctggatcacctcctttctaagga

SEQ ID NO: 8293 - DNA, 1056 bp, Selenomonas sp. oral taxon 892
  ref <308>: DATABASE ACCESSION NUMBER: NCBI ACCESSION: NZ_KI260519.1
  ref <309>: DATABASE ENTRY DATE: 2019-04-01
  ref <313>: RELEVANT RESIDUES IN SEQ ID NO: (1)..(1056)
aatgacggtacctatcgaggaagccacggctaactacgtgccagcagccgcggtaatacgtaggtggcgagcgttgtccggaatcattgggcgtaaagggagcgcaggcgggcatgtaagtctttcttaaaagttcggggctcaaccccgtgatgggaaagaaactacatgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggccttgacattgactgaaagtgctagagatagcaccctctcttcggagacaggaaaacaggtggtgcatggctgtcgtcagctcgtgtcgtgagatgttgggttaagtcccgcaacgagcgcaacccctgttctttgttgccatcaggtagagctgggcactcaaaggagactgccgcggagaacgcggaggaaggcggggatgacgtcaagtcatcatgccccttatggtctgggctacacacgtactacaatggaacggacagagagcagcgaacccgcgagggcaagcgaacctcaaaaaccgtttcccagttcggattgcaggctgcaactcgcctgcatgaagtcggaatcgctagtaatcgcaggtcagcatactgcggtgaatacgttcccgggtcttgtacacaccgcccgtcacaccacggaagtcgttcacacccgaagccggcgcagccgtctaaggtggggaaggtgactggggtgaagtcgtaacaaggtagccgtatcggaaggtgcggctggatcacctcctttctaagga

SEQ ID NO: 8294 - DNA, 1548 bp, Selenomonas sp. oral taxon 920
  ref <308>: DATABASE ACCESSION NUMBER: NCBI ACCESSION: NZ_CP017042.1
  ref <309>: DATABASE ENTRY DATE: 2019-04-01
  ref <313>: RELEVANT RESIDUES IN SEQ ID NO: (1)..(1548)
attagcggagagtttgatcctggctcaggacgaacgctggcggcgtgcttaacacatgcaagtcgaacggagcgaatgaaagcttgcttttataagcttagtggcaaacgggtgagtaacacgtagacaacctgccgacaggatggggacaacattccgaaaggaatgctaataccgaatgaagtcagagaagggcatccttttctgatgaaagatggcctctatatataagctatcacctgttgatgggtctgcgtctgattagctggtaggtgaggtaacggctcacctaggcgacgatcagtagccggtctgagaggatgaacggccacattgggactgagacacggcccagactcctacgggaggcagcagtggggaatcttccgcaatgggcgcaagcctgacggagcaacgccgcgtgagtgaagaaggtcttcggatcgtaaagctctgttgatggggacgaacgtgcctaatgcgaatagttttaggtaatgacggtacccatcgaggaagccacggctaactacgtgccagcagccgcggtaatacgtaggtggcgagcgttgtccggaatcattgggcgtaaagggagcgcaggcgggcatgtaagtctttcttaaaagtgcggggctcaaccccgtgatgggaaagaaactatgtgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggccgcaaggctgaaactcaaaggaattgacggggacccgcacaagcggtggagtatgtggtttaattcgaagcaacgcgaagaaccttaccaggccttgacattgactgaaagagctagagatagctccctctcttcggagacaggaaaacaggtggtgcatggctgtcgtcagctcgtgtcgtgagatgttgggttaagtcccgcaacgagcgcaacccctgttctttgttgccatcaggtaaagctgggcactcaaaggagactgccgcggagaacgcggaggaaggcggggatgacgtcaagtcatcatgccccttatggtctgggctacacacgtactacaatgggacggacagagggcagcgagagagtgatcttaagcgaatctcaaaaaccgtttctcagttcggattgcaggctgcaactcgcctgcatgaagtcggaatcgctagtaatcgcaggtcagcatactgcggtgaatacgttcccgggtcttgtacacaccgcccgtcacaccacggaagtcgttcacacccgaagccggcgcagccgtctaaggtggggagggtgactggggtgaagtcgtaacaaggtagccgtatcggaaggtgcggctggatcacctcctttcta

SEQ ID NO: 8295 - DNA, 1562 bp, Selenomonas sputigena
  ref <308>: DATABASE ACCESSION NUMBER: NCBI ACCESSION: NC_015437.1
  ref <309>: DATABASE ENTRY DATE: 2019-04-01
  ref <313>: RELEVANT RESIDUES IN SEQ ID NO: (1)..(1562)
tttttcggagagtttgatcctggctcaggacgaacgctggcggcgtgcttaacacatgcaagtcgaacgggaacctttatttcggtaaaggtgagagtggcaaacgggtgagtaacacgtaggcaacctgccgacaggatggggacaacattccgaaaggaatgctaataccgaatggagtccggggatggcatcatccctggataaaagatggcctctgaatatgctatcgcctgtcgatgggcctgcgtctgattagccagttggcggggtaacggcccaccaaagcgacgatcagtagccggtctgagaggatgaacggccacattgggactgagacacggcccagactcctacgggaggcagcagtggggaatcttccacaatgggcgaaagcctgatggagcaacgccgcgtgagtgaagaaggtcttcggatcgtaaagctctgttgcacgggacgaaaaccgagcttgagaatattgagtttgggtgacggtaccgagcgaggaagccacggctaactacgtgccagcagccgcggtaatacgtaggtggcgagcgttgtccggaattattgggcgtaaagggagcgcaggcggacatataagtccatcttaaaagtgcggggctcaaccccgtgaggggatggaaactgtatgccttgagtgcaggagaggaaagcggaattcccagtgtagcggtgaaatgcgtagatattgggaggaacaccagtggcgaaggcggctttctggactgtaactgacgctgaggctcgaaagccaggggagcgaacgggattagataccccggtagtcctggccgtaaacgatgaatgctaggtgtaggaggtatcgacccctcctgtgccggagttaacgcaataagcattccgcctggggagtacggtcgcaagactgaaactcaaaggaattgacgggggcccgcacaagcggtggagtatgtggtttaattcgacgcaacgcgaagaaccttaccagggcttgacattgagtgaaagagctagagatagcttcctcccttcggggacacgaaaacaggtggtgcatggctgtcgtcagctcgtgtcgtgagatgttgggttaagtcccgcaacgagcgcaacccctgtcctttgttgccagcgcgtaatggcgggaactcaaaggagactgccgcggagaacgcggaggaaggcggggatgacgtcaagtcatcatgccccttatgtcctgggctacacacgtactacaatgggatggacagagggaagcgaaggcgtgagccggagcggaccccacaaaccatcccccagttcggattgcaggctgcaacccgcctgcatgaagtcggaatcgctagtaatcgcaggtcagcatactgcggtgaatacgttcccgggccttgtacacaccgcccgtcacaccacggaagtcattcacgcccaaagccggtgggccaaccgcaaggaggcagctgtctaaggcgggggcgatgactggggtgaagtcgtaacaaggtagccgtatcggaaggtgcggctggatcacctcctttctaagg

SEQ ID NO: 8296 - DNA, 1522 bp, Senegalimassilia sp. KGMB04484
  ref <308>: DATABASE ACCESSION NUMBER: NCBI ACCESSION: NZ_SDPW01000001.1
  ref <309>: DATABASE ENTRY DATE: 2019-04-01
  ref <313>: RELEVANT RESIDUES IN SEQ ID NO: (1)..(1522)
ttcaacggagagtttgatcctggctcaggatgaacgctggcggcgtgcctaacacatgcaagtcgagcgatgaaaccgcctccgggcggacatgaagcggcgaacgggtgagtaacacgtgaccgacctgccccccgcccagggacagccccccgaaagggggattaatacctggtactccggaagcggcgcatgccgctcccgggaaagctttcgcggcgggggatggggtcgcggcccatcaggtagacggcggggcagaggcccaccgtgccgacgacgggtagccgggttgagagaccgaccggccacattgggactgagatacggcccagactcctacgggaggcagcagtggggaattttgcgcaatgggggcaaccctgacgcagcaacgccgcgtgcgggacgaaggcgtccgcgtcgtaaaccgctttcagcggggaacacttcaacgagggtacccgcagaagaagccccggctaaatacgtgccagcagccgcggtaatacgtatggggcgagcgttatccggattcattgggcgtaaagcgcgcgtaggcggagcgctaagcgggacctctaacccgagggctcaacccccggccgggtcccgaactggcgctctcgagtgcggtaggggagagcggaattcccggtgtagcggtggaatgcgcagatatcgggaggaacaccgacggcgaaggcagctctctgggccgaaactgacgctgaggcgcgaaagctgggggagcgaacaggattagataccctggtagtcccagccgtaaacgatgggcgctaggtgtgggggataacatcttccgcgccgcagccaacgcgttaagcgccccgcctggggagtacggccgcaaggctaaaactcaaaggaattgacgggggcccgcacaagcagcggagcatgtggcttaattcgaagcaacgcgaagaaccttaccagggcttgacatcaccgtgaagcggcggagacgccgtggccggaaggagcggtgacaggtggtgcatggctgtcgtcagctcgtgccgtgaggtgttgggttaagtcccgcaacgagcgcaacccctgccccgtgttgccagcattcagttggggactcgcgggggaccgccggcgtcaagccggaggaaggcggggacgacgtcaagtcatcatgccccttatgccctgggccgcacacgtgctacaatggccggtacagagggttgccaccccgcgagggggagcggatcccgcaaagccggccccagttcggatcggaggctgcaacccgcctccgtgaagccggagttgctagtaatcgcggatcagcacgccgcggtgaatacgttcccgggccttgtacacaccgcccgtcacaccacccgagtcgtctgcacccgaagccgccggccgaacccctccggggggcggaggcgtcgaaggtgtggagggtgaggggggtgaagtcgtaacaaggtagccgtaccggaaggtgcggctggatcacctcctttctagggag

SEQ ID NO: 8297 - DNA, 1521 bp, Seonamhaeicola aphaedonensis
  ref <308>: DATABASE ACCESSION NUMBER: NCBI ACCESSION: NZ_QRDX01000014.1
  ref <309>: DATABASE ENTRY DATE: 2019-04-01
  ref <313>: RELEVANT RESIDUES IN SEQ ID NO: (1)..(1521)
aacaatgaagagtttgatcctggctcaggatgaacgctagcggcaggcctaacacatgcaagtcgaacggtaacattggtgcttgcaccagatgacgagtggcgcacgggtgcgtaacgcgtatgcaacctacctcttactgggagatagcctctggaaacggagattaataccccatagtatttatgattggcatcgattatagattaaaggttacggtaagagatgggcatgcgtcctattagctagttggtatggtaacggcataccaaggcaacgataggtaggggccctgagagggggatcccccacactggtactgagacacggaccagactcctacgggaggcagcagtgaggaatattggacaatgggcggaagcctgatccagccatgccgcgtgcaggaagactgccctatgggttgtaaactgcttttgtacgggaagaaaccctccttcgtgaaggagcttgacggtaccgtaagaataagcatcggctaactccgtgccagcagccgcggtaatacggaggatgcaagcgttatccggaatcattgggtttaaagggtccgtaggtggatttgtaagtcagaggtgaaatcctgcagcttaactgtagaactgcctttgatactgctaatcttgagtcattgtgaagtagttagaatatgtagtgtagcggtgaaatgcatagatattacatagaataccaattgcgaaggcagattactaacaatgtactgacactgatggacgaaagcgtggggagcgaacgggattagataccccggtagtccacgccgtaaacgatggatactagctgtccggcttcggctgggtggctaagcgaaagtgataagtatcccacctggggagtacgttcgcaagaatgaaactcaaaggaattgacgggggcccgcacaagcggtggagcatgtggtttaattcgatgatacgcgaggaaccttaccagggcttaaatgtaagttgcatgatttagagatagatctttcttcggactacttacaaggtgctgcatggttgtcgtcagctcgtgccgtgaggtgtcaggttaagtcctataacgagcgcaacccctgttgttagttgccagcatgtaaagatgggaactctagcaagactgccggtgcaaaccgtgaggaaggtggggatgacgtcaaatcatcacggcccttacgtcctgggctacacacgtgctacaatggccggtacagagggcagccacaccgtgaggtggagcgaatccttaaaaccggtctcagttcggatcggagtctgcaactcgactccgtgaagctggaatcgctagtaatcggatatcagccatgatccggtgaatacgttcccgggccttgtacacaccgcccgtcaagccatggaagctgggagtgcctgaagtccgtcaccgcaaggagcggcctagggtaaaatcggtaactagggctaagtcgtaacaaggtagccgtaccggaaggtgcggctggaacacctcctttct

SEQ ID NO: 8298 - DNA, 1545 bp, Serinicoccus sp. GP-T3-3
  ref <308>: DATABASE ACCESSION NUMBER: NCBI ACCESSION: NZ_SDVA01000030.1
  ref <309>: DATABASE ENTRY DATE: 2019-04-01
  ref <313>: RELEVANT RESIDUES IN SEQ ID NO: (1)..(1545)
tttatcggagagtttgatcctggctcaggacgaacgctggcggcgtgcttaacacatgcaagtcgaacgatgaagcggtgcttgcaccgtggattagtggcgaacgggtgagtaacacgtgagtaacctgccttccactctgggataagcgctggaaacggcgtctaatactggatatgacattgccctgcatggggtggtgtggaaagatttatttcggtggttgatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagctctgacgaagcccgcttgcgggtgacggtaggagcagaagaagcaccggctaactacgtgccagcagccgcggtaatacgtagggtgcgagcgttgtccggaattattgggcgtaaagagcttgtaggcggcttgtcgcgtctgctgtgaaagcccggggcttaaccccgggtctgcagtgggtacgggcaggctagagtgtggtaggggagactggaattcctggtgtagcggtggaatgcgcagatatcaggaggaacaccgatggcgaaggcaggtctctgggccattactgacgctgagaagcgaaagcgtggggagcgaacaggattagataccctggtagtccacgccgtaaacgttgggcgctaggtgtgggtcccattccacggggtccgtgccgcagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggacgaccgcagagatgtggtttccctttgtggctggtgtacaggtggtgcatggttgtcgtcagctcgtgtcgtgagatgttgggttaagtcccgcaacgagcgcaaccctcgttccatgttgccagcaacacctttgggtggttggggactcatgggagactgccggggtcaactcggaggaaggtggggatgacgtcaaatcatcatgccccttacgtcttgggcttcacgcatgctacaatggccggtacaaagggctgcgatcccgtgagggggagcgaatcccagaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaacccttgtggagggagctgtcgaaggtgggactggtgattgggactaagtcgtaacaaggtagccgtaccggaaggtgcggctggatcacctcctttctaagga

SEQ ID NO: 8299 - DNA, 1547 bp, Serratia ficaria
  ref <308>: DATABASE ACCESSION NUMBER: NCBI ACCESSION: NZ_LT906479.1
  ref <309>: DATABASE ENTRY DATE: 2019-04-01
  ref <313>: RELEVANT RESIDUES IN SEQ ID NO: (1)..(1547)
tttaattgaagagtttgatcatggctcagattgaacgctggcggcaggcctaacacatgcaagtcgagcggtagcacaagagagcttgctctctgggtgacgagcggcggacgggtgagtaatgtctgggaaactgcctgatggagggggataactactggaaacggtagctaataccgcataacgtctacggaccaaagtgggggaccttcgggcctcacgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaagggcgatgtcttaatacggcatcgcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgtatacaaagagaagcgaactcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 8300 - DNA, 1078 bp, Serratia fonticola
  ref <308>: DATABASE ACCESSION NUMBER: NCBI ACCESSION: NZ_QRAU01000040.1
  ref <309>: DATABASE ENTRY DATE: 2019-04-01
  ref <313>: RELEVANT RESIDUES IN SEQ ID NO: (1)..(1078)
gttcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcgcgtaatggcgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 8301 - DNA, 1547 bp, Serratia grimesii
  ref <308>: DATABASE ACCESSION NUMBER: NCBI ACCESSION: NZ_UGYI01000001.1
  ref <309>: DATABASE ENTRY DATE: 2019-04-01
  ref <313>: RELEVANT RESIDUES IN SEQ ID NO: (1)..(1547)
ttaattgaagagtttgatcatggctcagattgaacgctggcggcaggcctaacacatgcaagtcgagcggtagcacaggagagcttgctctctgggtgacgagcggcggacgggtgagtaatgtctgggaaactgcctgatggagggggataactactggaaacggtagctaataccgcataacgtcttcggaccaaagtgggggaccttcgggcctcacgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaagggttcagtgttaatagcactgttcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcgcgtaatggcgggaactcaaaggagactgccggtgataaaccggaggaaggtggggatgacgtcaagtcatcatggcccttacgagtagggctacacacgtgctacaatggcgtatacaaagagaagcgaactcgcgagagcaagcggacctcataaagtacgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 8302 - DNA, 1545 bp, Serratia liquefaciens
  ref <308>: DATABASE ACCESSION NUMBER: NCBI ACCESSION: NZ_MQMZ01000015.1
  ref <309>: DATABASE ENTRY DATE: 2019-04-01
  ref <313>: RELEVANT RESIDUES IN SEQ ID NO: (1)..(1545)
ttaattgaagagtttgatcatggctcagattgaacgctggcggcaggcctaacacatgcaagtcgagcggtagcacagggagcttgctcctgggtgacgagcggcggacgggtgagtaatgtctgggaaactgcctgatggagggggataactactggaaacggtagctaataccgcataacgtctacggaccaaagtgggggaccttcgggcctcatgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaagggttcagtgttaatagcactgttcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcgtatacaaagagaagcgaactcgcgagagcaagcggacctcataaagtacgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 8303 - DNA, 1458 bp, Serratia marcescens
  ref <308>: DATABASE ACCESSION NUMBER: NCBI ACCESSION: NZ_ULGO01000030.1
  ref <309>: DATABASE ENTRY DATE: 2019-04-01
  ref <313>: RELEVANT RESIDUES IN SEQ ID NO: (1)..(1458)
gggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggtggtgagcttaatacgctcatcaattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 8304 - DNA, 1079 bp, Serratia marcescens subsp. sakuensis
tcatcaattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 8305 - DNA, 1079 bp, Serratia marcescens subsp. sakuensis; identical to SEQ ID NO: 8304

SEQ ID NO: 8306 - DNA, 1551 bp, Serratia marcescens subsp. sakuensis
ttaattgaagagtttgatcatggctcagattgaacgctggcggcaggcttaacacatgcaagtcgagcggtagcacaggggagcttgctccctgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggtggtgagcttaatacgttcatcaattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 8307 - DNA, 1079 bp, Serratia marcescens subsp. sakuensis; identical to SEQ ID NO: 8304

SEQ ID NO: 8308 - DNA, 1079 bp, Serratia marcescens subsp. sakuensis; identical to SEQ ID NO: 8304

SEQ ID NO: 8309 - DNA, 1546 bp, Serratia odorifera
ttaattgaagagtttgatcatggctcagattgaacgctggcggcaggcctaacacatgcaagtcgagcggtagcacaggagagcttgctctccgggtgacgagcggcggacgggtgagtaatgtctgggaaactgcccgatggagggggataaccactggaaacggtggctaataccgcataacgtctacggaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggccaataacttaatacgttgttggattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggaagggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgaacttgcgagagtaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 8310 - DNA, 1548 bp, Serratia odorifera
  ref <308>: DATABASE ACCESSION NUMBER: NCBI ACCESSION: NZ_LR134117.1
  ref <309>: DATABASE ENTRY DATE: 2019-04-01
  ref <313>: RELEVANT RESIDUES IN SEQ ID NO: (1)..(1548)
ttaattgaagagtttgatcatggctcagattgaacgctggcggcaggcctaacacatgcaagtcgagcggtagcacaggagagcttgctctccgggtgacgagcggcggacgggtgagtaatgtctgggaaactgcccgatggagggggataaccactggaaacggtggctaataccgcataacgtctacggaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggccaatagcttaatacgctgttggattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactatccagagatggatgggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgaacttgcgagagtaagcggacctcataaagtacgtcgtagtccggattggagtctgcaactcggactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 8311 - DNA, 1546 bp, Serratia odorifera; identical to SEQ ID NO: 8309

SEQ ID NO: 8312 - DNA, 1545 bp, Serratia oryzae
  ref <308>: DATABASE ACCESSION NUMBER: NCBI ACCESSION: NZ_MOXD01000038.1
  ref <309>: DATABASE ENTRY DATE: 2019-04-01
  ref <313>: RELEVANT RESIDUES IN SEQ ID NO: (1)..(1545)
ttaattgaagagtttgatcatggctcagattgaacgctggcggcaggcctaacacatgcaagtcgagcggcagcggaaagtagcttgctactttgccggcgagcggcggacgggtgagtaatgtctgggaaactgcctgatggagggggataactactggaaacggtggctaataccgcataacgtcgcaagaccaaagtgggggaccttcgggcctcacgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcatcacacttaatacgtgtggtgattgacgttactcgcagaagaagcaccggctaactccgtgccagcagccgcggtaatacggagggtgcgagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaacttgccagagatggcttggtgccttcgggaaccgtgagacaggtgctgcatggctgtcgtcagctcgtgttgtgaaatgttgggttaagtcccgcaacgagcgcaacccttatcctttgttgccagcacttcgggtgggaactcaaaggagactgccggtgataaaccggaggaaggtggggatgacgtcaagtcatcatggcccttacgagtagggctacacacgtgctacaatggcgtatacaaagagaagcaaactcgcgagagccagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacc

SEQ ID NO: 8313 - DNA, 1545 bp, Serratia plymuthica
  ref <308>: DATABASE ACCESSION NUMBER: NCBI ACCESSION: NZ_LR134478.1
  ref <309>: DATABASE ENTRY DATE: 2019-04-01
  ref <313>: RELEVANT RESIDUES IN SEQ ID NO: (1)..(1545)
aaattgaagagtttgatcatggctcagattgaacgctggcggcaggcctaacacatgcaagtcgagcggtagcacaggagagcttgctctccgggtgacgagcggcggacgggtgagtaatgtctgggaaactgcctgatggagggggataactactggaaacggtagctaataccgcataacgtctacggaccaaagtgggggaccttcgggcctcacgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaagggttcagtgttaatagcactgttcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgtatacaaagagaagcgaactcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 8314 - DNA, 1087 bp, Serratia plymuthica
tgtgttaatagcacattgcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgtatacaaagagaagcgaactcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 8315 - DNA, 1547 bp, Serratia proteamaculans
  ref <308>: DATABASE ACCESSION NUMBER: NCBI ACCESSION: NZ_UGYL01000001.1
  ref <309>: DATABASE ENTRY DATE: 2019-04-01
  ref <313>: RELEVANT RESIDUES IN SEQ ID NO: (1)..(1547)
ttaattgaagagtttgatcatggctcagattgaacgctggcggcaggcctaacacatgcaagtcgagcggtagcacaggagagcttgctctctgggtgacgagcggcggacgggtgagtaatgtctgggaaactgcctgatggagggggataactactggaaacggtagctaataccgcataacgtcttcggaccaaagtgggggaccttcgggcctcatgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaagggtagtgtgttaatagcacattgcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcgtatacaaagagaagcgaactcgcgagagcaagcggacctcataaagtacgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 8316 - DNA, 1547 bp, Serratia quinivorans
  ref <308>: DATABASE ACCESSION NUMBER: NCBI ACCESSION: NZ_LR134494.1
  ref <309>: DATABASE ENTRY DATE: 2019-04-01
  ref <313>: RELEVANT RESIDUES IN SEQ ID NO: (1)..(1547)
ttaattgaagagtttgatcatggctcagattgaacgctggcggcaggcctaacacatgcaagtcgagcggtagcacaggagagcttgctctctgggtgacgagcggcggacgggtgagtaatgtctgggaaactgcctgatggagggggataactactggaaacggtagctaataccgcataacgtcttcggaccaaagtgggggaccttcgggcctcacgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaagggcagtgtgttaatagcacattgcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcgtatacaaagagaagcgaactcgcgagagccagcggacctcataaagtacgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 8317 - DNA, 1551 bp, Serratia rubidaea
  ref <308>: DATABASE ACCESSION NUMBER: NCBI ACCESSION: NZ_LR134493.1
  ref <309>: DATABASE ENTRY DATE: 2019-04-01
  ref <313>: RELEVANT RESIDUES IN SEQ ID NO: (1)..(1551)
ttaattgaagagtttgatcatggctcagattgaacgctggcggcaggcctaacacatgcaagtcgagcggcagcgggaggaagcttgcttcctcgccggcgagcggcggacgggtgagtaatgtctggggatctgcccgatggagggggataaccactggaaacggtggctaataccgcataacgtcgcaagaccaaagtgggggaccttcgggcctcacaccatcggatgaacccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggtggtgagcttaatacgctcatcaattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaggctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgaacctgcgagggcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 8318 - DNA, 1546 bp, Serratia sp. 1D1416
  ref <308>: DATABASE ACCESSION NUMBER: NCBI ACCESSION: NZ_CP032738.1
  ref <309>: DATABASE ENTRY DATE: 2019-04-01
  ref <313>: RELEVANT RESIDUES IN SEQ ID NO: (1)..(1546)
ttaattgaagagtttgatcatggctcagattgaacgctggcggcaggcctaacacatgcaagtcgagcggtagcacaagagagcttgctctctgggtgacgagcggcggacgggtgagtaatgtctgggaaactgcctgatggagggggataactactggaaacggtagctaataccgcataacgtctacggaccaaagtgggggaccttcgggcctcacgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaagggcgatgtcttaatacggcagcgcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgtatacaaagagaagcgaactcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 8319 - DNA, 1550 bp, Serratia sp. 3ACOL1
  ref <308>: DATABASE ACCESSION NUMBER: NCBI ACCESSION: NZ_CP033055.1
  ref <309>: DATABASE ENTRY DATE: 2019-04-01
  ref <313>: RELEVANT RESIDUES IN SEQ ID NO: (1)..(1550)
ttaattgaagagtttgatcatggctcagattgaacgctggcggcaggcctaacacatgcaagtcgagcggtagcacaaggagcttgctcctgggtgacgagcggcggacgggtgagtaatgtctgggaaactgcccgatggagggggataactactggaaacggtagctaataccgcataacgtcttcggaccaaagtgggggaccttcgggcctcacaccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaagggttcggtgttaatagcaccgttcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcacgtcatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 8320 - DNA, 1550 bp, Serratia sp. ATCC 39006
  ref <308>: DATABASE ACCESSION NUMBER: NCBI ACCESSION: NZ_CP025085.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggcagcggggggaagcttgcttccccgccggcgagcggcggacgggtgagtaatgtctggggatctgcctgatggagggggataactactggaaacggtagctaataccgcatgacgtcgcaagaccaaagtgggggaccttagggcctcacgccattggatgaacccagatgggattagctggtaggtgaggtaatggctcacctaggcgacgatctctagctggtctgagaggatgaccagccacactggaactgagacacggtccagactcctacgggaggcagcagtggggaatattgcacaatgggggaaaccctgatgcagccatgccgcgtgtatgaagaaggccttcgggttgtaaagtactttcagcggggaggaaggggagcactttaacagagtgtttcattgacgttacccgcagaagaagcaccggctaactccgtgccagcagccgcggtaatacggagggtgcaagcgttaatcggaatgactgggcgtaaagcgcacgcaggcggtctgttaagttggatgtgaaatccccgggcttaacctgggaactgcattcaaaactgacagactagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgacttgaaggttgtggccttgagccgtggctttcggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatcctcagaagagactggagacagttttgtgccttcgggaactgagagacaggtgctgcatggctgtcgtcagctcgtgttgtgaaatgttgggttaagtcccgcaacgagcgcaacccttatcctttgttgccagcgcgtaatggcgggaactcaagggagactgccggtgataaaccggaggaaggtggggatgacgtcaagtcatcatggcccttacgagtagggctacacacgtgctacaatggcgcatacaaagagaagcgaactcgcgagggcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccaaaga

SEQ ID NO: 8321 - DNA, 1548 bp, Serratia sp. BW106
  ref <308>: DATABASE ACCESSION NUMBER: NCBI ACCESSION: NZ_MCGS01000065.1
  ref <309>: DATABASE ENTRY DATE: 2019-04-01
  ref <313>: RELEVANT RESIDUES IN SEQ ID NO: (1)..(1548)
tttaattgaagagtttgatcatggctcagattgaacgctggcggcaggcctaacacatgcaagtcgagcggtagcacaggagagcttgctctctgggtgacgagcggcggacgggtgagtaatgtctgggaaactgcctgatggagggggataactactggaaacggtagctaataccgcataacgtcttcggaccaaagtgggggaccttcgggcctcacgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaagggtagtgtgttaatagcacattacattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaattcggcagagatgccttagtgccttcgggaactgtgagacaggtgctgcatggctgtcgtcagctcgtgttgtgaaatgttgggttaagtcccgcaacgagcgcaacccttatcctttgttgccagcgcgtaatggcgggaactcaaaggagactgccggtgataaaccggaggaaggtggggatgacgtcaagtcatcatggcccttacgagtagggctacacacgtgctacaatggcgtatacaaagagaagcgaactcgcgagagccagcggacctcataaagtacgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 8322 - DNA, 1547 bp, Serratia sp. C-1
  ref <308>: DATABASE ACCESSION NUMBER: NCBI ACCESSION: NZ_CAQO01000012.1
  ref <309>: DATABASE ENTRY DATE: 2019-04-01
  ref <313>: RELEVANT RESIDUES IN SEQ ID NO: (1)..(1547)
ttaaattgaagagtttgatcatggctcagattgaacgctggcggcaggcctaacacatgcaagtcgagcggtagcacaggagagcttgctctctgggtgacgagcggcggacgggtgagtaatgtctgggaaactgcctgatggagggggataactactggaaacggtagctaataccgcataacgtctacggaccaaagtgggggaccttcgggcctcacgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaagggtagtgtgttaatagcacattgcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgtatacaaagagaagcgaactcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 8323 - DNA, 1551 bp, Serratia sp. FDAARGOS 506
  ref <308>: DATABASE ACCESSION NUMBER: NCBI ACCESSION: NZ_CP033831.1
  ref <309>: DATABASE ENTRY DATE: 2019-04-01
  ref <313>: RELEVANT RESIDUES IN SEQ ID NO: (1)..(1551)
ttaattgaagagtttgatcatggctcagattgaacgctggcggcaggcttaacacatgcaagtcgagcggtagcacaagggagcttgctccctgggtgacgagcggcggacgggtgagtaatgtctgggaaactgcctgatggagggggataactactggaaacggtagctaataccgcataatgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggtggtgagcttaatacgctcatcaattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 8324 - DNA, 1545 bp, Serratia sp. FGI94
  ref <308>: DATABASE ACCESSION NUMBER: NCBI ACCESSION: NC_020064.1
  ref <309>: DATABASE ENTRY DATE: 2019-04-01
  ref <313>: RELEVANT RESIDUES IN SEQ ID NO: (1)..(1545)
ttaattgaagagtttgatcatggctcagattgaacgctggcggcaggcctaacacatgcaagtcgagcggcagcgggaggaagcttgcttcctcgccggcgagcggcggacgggtgagtaatgtctggggatctgcccgatggagggggataaccactggaaacggtggctaataccgcataacgtcgcaagaccaaagtgggggaccttcgggcctcacaccatcggatgaacccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggtggtgaacttaatacgttcatcaattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgtatacaaagagaagcgaacctgcgaaggcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacc

SEQ ID NO: 8325 - DNA, 1550 bp, Serratia sp. H1n
  ref <308>: DATABASE ACCESSION NUMBER: NCBI ACCESSION: NZ_AYMN01000124.1
  ref <309>: DATABASE ENTRY DATE: 2019-04-01
  ref <313>: RELEVANT RESIDUES IN SEQ ID NO: (1)..(1550)
ttaattgaagagtttgatcatggctcagattgaacgctggcggcaggcctaacacatgcaagtcgagcggtagcacagggagcttgctcctgggtgacgagcggcggacgggtgagtaatgtctgggaaactgcccgatggagggggataactactggaaacggtagctaataccgcataacgtcttcggaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaagggttcggtgttaatagcaccgttcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcgcgtaatggcgggaactcaaaggagactgccggtgataaaccggaggaaggtggggatgacgtcaagtcatcatggcccttacgagtagggctacacacgtgctacaatggcatatacaaagagaagcaaactcgcgagagcaagcggacctcataaagtatgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 8326 - DNA, 1550 bp, Serratia sp. H1w; identical to SEQ ID NO: 8325
  ref <308>: DATABASE ACCESSION NUMBER: NCBI ACCESSION: NZ_AYMQ01000030.1
  ref <309>: DATABASE ENTRY DATE: 2019-04-01
  ref <313>: RELEVANT RESIDUES IN SEQ ID NO: (1)..(1550)

SEQ ID NO: 8327 - DNA, 1552 bp, Serratia sp. JKS000199
  ref <308>: DATABASE ACCESSION NUMBER: NCBI ACCESSION: NZ_LT907843.1
  ref <309>: DATABASE ENTRY DATE: 2019-04-01
  ref <313>: RELEVANT RESIDUES IN SEQ ID NO: (1)..(1552)
tttaattgaagagtttgatcatggctcagattgaacgctggcggcaggcttaacacatgcaagtcgagcggtagcacaggggagcttgctccccgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggtggtgagcttaatacgctcatcaattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 8328 - DNA, 1551 bp, Serratia sp. JKS296
  ref <308>: DATABASE ACCESSION NUMBER: NCBI ACCESSION: NZ_OCMX01000001.1
  ref <309>: DATABASE ENTRY DATE: 2019-04-01
  ref <313>: RELEVANT RESIDUES IN SEQ ID NO: (1)..(1551)
ttaattgaagagtttgatcatggctcagattgaacgctggcggcaggcttaacacatgcaagtcgagcggtagcacaggggagcttgctccctgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggtggtgagcttaatacgctcatcaattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 8329 - DNA, 1551 bp, Serratia sp. LS-1
  ref <308>: DATABASE ACCESSION NUMBER: NCBI ACCESSION: NZ_CP033504.1
  ref <309>: DATABASE ENTRY DATE: 2019-04-01
  ref <313>: RELEVANT RESIDUES IN SEQ ID NO: (1)..(1551)
ttaattgaagagtttgatcatggctcagattgaacgctggcggcaggcttaacacatgcaagtcgagcggtagcacaggggagcttgctccctgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggtggtgagcttaatacgctcatcaattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 8330 - DNA, 1368 bp, Serratia sp. M24T3
  ref <308>: DATABASE ACCESSION NUMBER: NCBI ACCESSION: NZ_AJHJ01000075.1
  ref <309>: DATABASE ENTRY DATE: 2019-04-01
  ref <313>: RELEVANT RESIDUES IN SEQ ID NO: (1)..(1368)
gtcgcaagaccaaagtgggggaccttcgggcctcacgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcgttgtagttaatagctgcagcgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcgctagagatagcttagtgccttcgggaaccgtgagacaggtgctgcatggctgtcgtcagctcgtgttgtgaaatgttgggttaagtcccgcaacgagcgcaacccttatcctttgttgccagcacgtgatggtgggaactcaaaggagactgccggtgataaaccggaggaaggtggggatgacgtcaagtcatcatggcccttacgagtagggctacacacgtgctacaatggcgtatacaaagagaagcgaactcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 8331 - DNA, 1551 bp, Serratia sp. MYb239
  ref <308>: DATABASE ACCESSION NUMBER: NCBI ACCESSION: NZ_CP023268.1
  ref <309>: DATABASE ENTRY DATE: 2019-04-01
  ref <313>: RELEVANT RESIDUES IN SEQ ID NO: (1)..(1551)
ttaattgaagagtttgatcatggctcagattgaacgctggcggcaggcctaacacatgcaagtcgagcggcagcggaaagtagcttgctactttgccggcgagcggcggacgggtgagtaatgtctgggaaactgcccgatggagggggataaccactggaaacggtggctaataccgcataacgtcttcggaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaagggtagtgtcttaatacggcattacattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcagactagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgaacctgcgaaggcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 8332 - DNA, 1079 bp, Serratia sp. Nf2
  ref <308>: DATABASE ACCESSION NUMBER: NCBI ACCESSION: NZ_PYTW01000037.1
  ref <309>: DATABASE ENTRY DATE: 2019-04-01
  ref <313>: RELEVANT RESIDUES IN SEQ ID NO: (1)..(1079)
tcatcaattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 8333 - DNA, 1551 bp, Serratia sp. OLAL2
  ref <308>: DATABASE ACCESSION NUMBER: NCBI ACCESSION: NZ_MSTL01000029.1
  ref <309>: DATABASE ENTRY DATE: 2019-04-01
  ref <313>: RELEVANT RESIDUES IN SEQ ID NO: (1)..(1551)
ttaattgaagagtttgatcatggctcagattgaacgctggcggcaggcttaacacatgcaagtcgagcggtagcacaggggagcttgctccctgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggtggtgagcttaatacgctcatcaattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 8334 - DNA, 1551 bp, Serratia sp. OLBL1
  ref <308>: DATABASE ACCESSION NUMBER: NCBI ACCESSION: NZ_MORD01000135.1
  ref <309>: DATABASE ENTRY DATE: 2019-04-01
  ref <313>: RELEVANT RESIDUES IN SEQ ID NO: (1)..(1551)
ttaattgaagagtttgatcatggctcagattgaacgctggcggcaggcttaacacatgcaagtcgagcggtagcacaggggagcttgctccccgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggtggtgagcttaatacgctcatcaattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 8335 - DNA, 1551 bp, Serratia sp. OLCL1; identical to SEQ ID NO: 8334
  ref <308>: DATABASE ACCESSION NUMBER: NCBI ACCESSION: NZ_MORE01000104.1
  ref <309>: DATABASE ENTRY DATE: 2019-04-01
  ref <313>: RELEVANT RESIDUES IN SEQ ID NO: (1)..(1551)

SEQ ID NO: 8336 - DNA, 1551 bp, Serratia sp. OLDL1; identical to SEQ ID NO: 8334
  ref <308>: DATABASE ACCESSION NUMBER: NCBI ACCESSION: NZ_MORF01000070.1
  ref <309>: DATABASE ENTRY DATE: 2019-04-01
  ref <313>: RELEVANT RESIDUES IN SEQ ID NO: (1)..(1551)

SEQ ID NO: 8337 - DNA, 1551 bp, Serratia sp. OLEL1; identical to SEQ ID NO: 8334
  ref <308>: DATABASE ACCESSION NUMBER: NCBI ACCESSION: NZ_MORG01000051.1
  ref <309>: DATABASE ENTRY DATE: 2019-04-01
  ref <313>: RELEVANT RESIDUES IN SEQ ID NO: (1)..(1551)

SEQ ID NO: 8338 - DNA, 1551 bp, Serratia sp. OLFL2; identical to SEQ ID NO: 8334
  ref <308>: DATABASE ACCESSION NUMBER: NCBI ACCESSION: NZ_MORH01000081.1
  ref <309>: DATABASE ENTRY DATE: 2019-04-01
  ref <313>: RELEVANT RESIDUES IN SEQ ID NO: (1)..(1551)

SEQ ID NO: 8339 - DNA, 1551 bp, Serratia sp. OLHL2; identical to SEQ ID NO: 8334
  ref <308>: DATABASE ACCESSION NUMBER: NCBI ACCESSION: NZ_MORI01000047.1
  ref <309>: DATABASE ENTRY DATE: 2019-04-01
  ref <313>: RELEVANT RESIDUES IN SEQ ID NO: (1)..(1551)

SEQ ID NO: 8340 - DNA, 1551 bp, Serratia sp. OLIL2; identical to SEQ ID NO: 8334
  ref <308>: DATABASE ACCESSION NUMBER: NCBI ACCESSION: NZ_MOWN01000107.1
  ref <309>: DATABASE ENTRY DATE: 2019-04-01
  ref <313>: RELEVANT RESIDUES IN SEQ ID NO: (1)..(1551)

SEQ ID NO: 8341 - DNA, 1551 bp, Serratia sp. OLJL1; identical to SEQ ID NO: 8334
  ref <308>: DATABASE ACCESSION NUMBER: NCBI ACCESSION: NZ_MOWO01000093.1
  ref <309>: DATABASE ENTRY DATE: 2019-04-01
  ref <313>: RELEVANT RESIDUES IN SEQ ID NO: (1)..(1551)

SEQ ID NO: 8342 - DNA, 1551 bp, Serratia sp. OLLOLW30; identical to SEQ ID NO: 8334
  ref <308>: DATABASE ACCESSION NUMBER: NCBI ACCESSION: NZ_MKYT01000012.1
  ref <309>: DATABASE ENTRY DATE: 2019-04-01
  ref <313>: RELEVANT RESIDUES IN SEQ ID NO: (1)..(1551)

SEQ ID NO: 8343 - DNA, 1551 bp, Serratia sp. OLMTLW26; identical to SEQ ID NO: 8334
  ref <308>: DATABASE ACCESSION NUMBER: NCBI ACCESSION: NZ_MNBD01000108.1
  ref <309>: DATABASE ENTRY DATE: 2019-04-01
  ref <313>: RELEVANT RESIDUES IN SEQ ID NO: (1)..(1551)

SEQ ID NO: 8344 - DNA, 1551 bp, Serratia sp. OMLW3; identical to SEQ ID NO: 8333
  ref <308>: DATABASE ACCESSION NUMBER: NCBI ACCESSION: NZ_MSTK01000049.1
  ref <309>: DATABASE ENTRY DATE: 2019-04-01
  ref <313>: RELEVANT RESIDUES IN SEQ ID NO: (1)..(1551)

SEQ ID NO: 8345 - DNA, 1551 bp, Serratia sp. OPWLW2; identical to SEQ ID NO: 8334
  ref <308>: DATABASE ACCESSION NUMBER: NCBI ACCESSION: NZ_MTCF01000064.1
  ref <309>: DATABASE ENTRY DATE: 2019-04-01
  ref <313>: RELEVANT RESIDUES IN SEQ ID NO: (1)..(1551)

SEQ ID NO: 8346 - DNA, 1551 bp, Serratia sp. OPWLW3; identical to SEQ ID NO: 8334
  ref <308>: DATABASE ACCESSION NUMBER: NCBI ACCESSION: NZ_MTCE01000041.1
  ref <309>: DATABASE ENTRY DATE: 2019-04-01
  ref <313>: RELEVANT RESIDUES IN SEQ ID NO: (1)..(1551)

SEQ ID NO: 8347 - DNA, 1551 bp, Serratia sp. OSPLW9; identical to SEQ ID NO: 8334
  ref <308>: DATABASE ACCESSION NUMBER: NCBI ACCESSION: NZ_MSTM01000052.1
  ref <309>: DATABASE ENTRY DATE: 2019-04-01
  ref <313>: RELEVANT RESIDUES IN SEQ ID NO: (1)..(1551)

SEQ ID NO: 8348 - DNA, 1547 bp, Serratia sp. P2ACOL2
  ref <308>: DATABASE ACCESSION NUMBER: NCBI ACCESSION: NZ_CP033162.1
  ref <309>: DATABASE ENTRY DATE: 2019-04-01
  ref <313>: RELEVANT RESIDUES IN SEQ ID NO: (1)..(1547)
ttaattgaagagtttgatcatggctcagattgaacgctggcggcaggcctaacacatgcaagtcgagcggtagcacaggagagcttgctctctgggtgacgagcggcggacgggtgagtaatgtctgggaaactgcctgatggagggggataactactggaaacggtagctaataccgcataatgtctacggaccaaagtgggggaccttcgggcctcatgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaagggtagtgtgttaatagcacattgcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcgtatacaaagagaagcgaactcgcgagagcaagcggacctcataaagtacgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 8349 - DNA, 1551 bp, Serratia sp. S1B
  ref <308>: DATABASE ACCESSION NUMBER: NCBI ACCESSION: NZ_PYUJ01000138.1
  ref <309>: DATABASE ENTRY DATE: 2019-04-01
  ref <313>: RELEVANT RESIDUES IN SEQ ID NO: (1)..(1551)
ttaattgaagagtttgatcatggctcagattgaacgctggcggcaggcttaacacatgcaagtcgagcggtagcacaggggagcttgctccctgggtgacgagcggcggacgggtgagtaatgtctgggaaactgcctgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaagggtggtgtgttaatagcgcatcacattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccacagaacttggtagagataccttggtgccttcgggacctgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgatccatgactggggtgaagtcgtaacaaggtaaccgtaggggaacctgcggttggatcacctccttacctaaaga

SEQ ID NO: 8350 - DNA, 1545 bp, Serratia sp. S40
  ref <308>: DATABASE ACCESSION NUMBER: NCBI ACCESSION: NZ_QYYG01000019.1
  ref <309>: DATABASE ENTRY DATE: 2019-04-01
  ref <313>: RELEVANT RESIDUES IN SEQ ID NO: (1)..(1545)
aaattgaagagtttgatcatggctcagattgaacgctggcggcaggcctaacacatgcaagtcgagcggtagcacaggagagcttgctctccgggtgacgagcggcggacgggtgagtaatgtctgggaaactgcctgatggagggggataactactggaaacggtagctaataccgcataacgtctacggaccaaagtgggggaccttcgggcctcacgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaagggcagtgtgttaatagcacattgcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgtatacaaagagaagcgaactcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 8351 - DNA, 1551 bp, Serratia sp. SSNIH1
  ref <308>: DATABASE ACCESSION NUMBER: NCBI ACCESSION: NZ_CP026383.1
  ref <309>: DATABASE ENTRY DATE: 2019-04-01
  ref <313>: RELEVANT RESIDUES IN SEQ ID NO: (1)..(1551)
ttaattgaagagtttgatcatggctcagattgaacgctggcggcaggcttaacacatgcaagtcgagcggtagcacaggggagcttgctccctgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggtggtgaacttaatacgttcatcaattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 8352 - DNA, 1551 bp, Serratia sp. SSNIH2
  ref <308>: DATABASE ACCESSION NUMBER: NCBI ACCESSION: NZ_PQJR01000049.1
  ref <309>: DATABASE ENTRY DATE: 2019-04-01
  ref <313>: RELEVANT RESIDUES IN SEQ ID NO: (1)..(1551)
ttaattgaagagtttgatcatggctcagattgaacgctggcggcaggcttaacacatgcaagtcgagcggtagcacaggggagcttgctccctgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggtggtgaacttaatacgttcaccaattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 8353 - DNA, 1551 bp, Serratia sp. SSNIH3; identical to SEQ ID NO: 8352
  ref <308>: DATABASE ACCESSION NUMBER: NCBI ACCESSION: NZ_PQJT01000050.1
  ref <309>: DATABASE ENTRY DATE: 2019-04-01
  ref <313>: RELEVANT RESIDUES IN SEQ ID NO: (1)..(1551)

SEQ ID NO: 8354 - DNA, 1551 bp, Serratia sp. SSNIH4; identical to SEQ ID NO: 8352
  ref <308>: DATABASE ACCESSION NUMBER: NCBI ACCESSION: NZ_PQJU01000053.1
  ref <309>: DATABASE ENTRY DATE: 2019-04-01
  ref <313>: RELEVANT RESIDUES IN SEQ ID NO: (1)..(1551)

SEQ ID NO: 8355 - DNA, 1551 bp, Serratia sp. SSNIH5; identical to SEQ ID NO: 8352
  ref <308>: DATABASE ACCESSION NUMBER: NCBI ACCESSION: NZ_PQJS01000062.1
  ref <309>: DATABASE ENTRY DATE: 2019-04-01
  ref <313>: RELEVANT RESIDUES IN SEQ ID NO: (1)..(1551)

SEQ ID NO: 8356 - DNA, 1460 bp, Serratia sp. TKO39
  ref <308>: DATABASE ACCESSION NUMBER: NCBI ACCESSION: NZ_PETD01000024.1
  ref <309>: DATABASE ENTRY DATE: 2019-04-01
  ref <313>: RELEVANT RESIDUES IN SEQ ID NO: (1)..(1460)
ctgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggtggtgaacttaatacgttcatcaattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 8357 - DNA, 1551 bp, Serratia ureilytica
  ref <308>: DATABASE ACCESSION NUMBER: NCBI ACCESSION: NZ_PGPC01000001.1
  ref <309>: DATABASE ENTRY DATE: 2019-04-01
  ref <313>: RELEVANT RESIDUES IN SEQ ID NO: (1)..(1551)
ttaattgaagagtttgatcatggctcagattgaacgctggcggcaggcttaacacatgcaagtcgagcggtagcacaggggagcttgctccctgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggtggtgagcttaatacgctcatcaattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 8358 - DNA, 1534 bp, Shewanella oneidensis
  ref <308>: DATABASE ACCESSION NUMBER: NCBI ACCESSION: NC_004347.2
  ref <309>: DATABASE ENTRY DATE: 2019-04-01
  ref <313>: RELEVANT RESIDUES IN SEQ ID NO: (1)..(1534)
agtttgatcatggctcagattgaacgctggcggcaggcctaacacatgcaagtcgagcggcagcacaagtgagtttactcatgaggtggcgagcggcggacgggtgagtaatgcctagggatctgcccagtcgagggggataacagttggaaacgactgctaataccgcatacgccctacgggggaaagagggggactttcgggcctctcgcgattggatgaacctaggtgggattagctagttggtgaggtaatggctcaccaaggcgacgatccctagctgttctgagaggatgatcagccacactgggactgagacacggcccagactcctacgggaggcagcagtggggaatattgcacaatgggggaaaccctgatgcagccatgccgcgtgtgtgaagaaggccttcgggttgtaaagcactttcagtagggaggaaagggtaagtcctaatacgacttatctgtgacgttacctacagaagaaggaccggctaactccgtgccagcagccgcggtaatacggagggtccgagcgttaatcggaattactgggcgtaaagcgtgcgcaggcggtttgttaagcgagatgtgaaagccctgggctcaacctaggaatcgcatttcgaactgaccaactagagtcttgtagaggggggtagaattccaggtgtagcggtgaaatgcgtagagatctggaggaataccggtggcgaaggcggccccctggacaaagactgacgctcatgcacgaaagcgtggggagcaaacaggattagataccctggtagtccacgccgtaaacgatgtctactcggagtttggtgtcttgaacactgggctctcaagctaacgcattaagtagaccgcctggggagtacggccgcaaggttaaaactcaaatgaattgacgggggcccgcacaagcggtggagcatgtggtttaattcgatgcaacgcgaagaaccttacctactcttgacatccacggaagactgcagagatgcggttgtgccttcgggaaccgtgagacaggtgctgcatggctgtcgtcagctcgtgttgtgaaatgttgggttaagtcccgcaacgagcgcaacccctatccttatttgccagcacgtaatggtgggaactctagggagactgccggtgataaaccggaggaaggtggggacgacgtcaagtcatcatggcccttacgagtagggctacacacgtgctacaatggcgagtacagagggttgcaaagccgcgaggtggagctaatctcacaaagctcgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaaaagaagtgggtagcttaaccttcgggggggcgctcaccactttgtggttcatgactggggtgaagtcgtaacaaggtagccctaggggaacctggggctggatcacctcctta

SEQ ID NO: 8359 - DNA, 1552 bp, Shigella boydii
  ref <308>: DATABASE ACCESSION NUMBER: NCBI ACCESSION: NZ_SAZA01000014.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaatcagcttgctgatttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 8360 - DNA, 1554 bp, Shigella dysenteriae
  ref <308>: DATABASE ACCESSION NUMBER: NCBI ACCESSION: NZ_UYIS01000022.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagtttccagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 8361 - DNA, 1554 bp, Shigella sp. FC1139
  ref <308>: DATABASE ACCESSION NUMBER: NCBI ACCESSION: NZ_MECX01000148.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaagcagcttgctgtttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgacttggaggttgtgcccttgaggtgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 8362 - DNA, 1554 bp, Shigella sp. FC1172
  ref <308>: DATABASE ACCESSION NUMBER: NCBI ACCESSION: NZ_MDJI01000165.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaagcagcttgctgtttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggtgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 8363 - DNA, 1554 bp, Shigella sp. FC1180; identical to SEQ ID NO: 8362
  ref <308>: DATABASE ACCESSION NUMBER: NCBI ACCESSION: NZ_MDJJ01000156.1
  ref <309>: DATABASE ENTRY DATE: 2019-04-01
  ref <313>: RELEVANT RESIDUES IN SEQ ID NO: (1)..(1554)

SEQ ID NO: 8364 - DNA, 1554 bp, Shigella sp. FC1544
  ref <308>: DATABASE ACCESSION NUMBER: NCBI ACCESSION: NZ_MECT01000275.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataatgtcgcaagaccaaagagggggaccttcgggcctcttgccatcggatgtgcccagatgggattagcttgttggtggggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttatccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 8365 - DNA, 1554 bp, Shigella sp. FC1567
  ref <308>: DATABASE ACCESSION NUMBER: NCBI ACCESSION: NZ_MIIV01000256.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaatcagcttgctgattcgctgacgagtggcggacgggtgagtaatgtctgggaaactgcctgatggagggggataactactggaaacggtagctaataccgcataatgtcgcaagaccaaagagggggaccttcgggcctcttgccatcggatgtgcccagatgggattagcttgttggtggggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggacgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 8366 - DNA, 1554 bp, Shigella sp. FC1764; identical to SEQ ID NO: 8365
  ref <308>: DATABASE ACCESSION NUMBER: NCBI ACCESSION: NZ_MDDH01000257.1
  ref <309>: DATABASE ENTRY DATE: 2019-04-01
  ref <313>: RELEVANT RESIDUES IN SEQ ID NO: (1)..(1554)

SEQ ID NO: 8367 - DNA, 1554 bp, Shigella sp. FC1882
  ref <308>: DATABASE ACCESSION NUMBER: NCBI ACCESSION: NZ_MDDI01000231.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaatcagcttgctgattcgctgacgagtggcggacgggtgagtaatgtctgggaaactgcctgatggagggggataactactggaaacggtagctaataccgcataatgtcgcaagaccaaagagggggaccttcgggcctcttgccatcggatgtgcccagatgggattagcttgttggtggggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttatccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggacgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 8368 - DNA, 617 bp, Shigella sp. FC1967
  ref <308>: DATABASE ACCESSION NUMBER: NCBI ACCESSION: NZ_MIIZ01001152.1
  ref <309>: DATABASE ENTRY DATE: 2019-04-01
  ref <313>: RELEVANT RESIDUES IN SEQ ID NO: (1)..(617)
gggggataactactggaaacggtggctaataccgcatgacgtctacggaccaaagcaggggctcttcggaccttgcgctatcggatgaacccatatgggattagctagtaggtggggtaatggctcacctaggcgacgatctctagctggtctgagaggatgatcagccacactgggactgagacacggcccagactcctacgggaggcagcagtggggaatattgcacaatgggcgcaagcctgatgcagccatgccgcgtgtatgaagaaggccttaggggttgtaaagtactttcagcgggggaggaaggtgataaggttaatacccttatcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggggtagaattccacgtgtagcggtgaaatgcgtagagatgtggaggaataccggtggcgaaggcggccccctggacaaagactgacgc

SEQ ID NO: 8369 - DNA, 1554 bp, Shigella sp. FC2045
  ref <308>: DATABASE ACCESSION NUMBER: NCBI ACCESSION: NZ_MDES01000097.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaaacagcttgctgtttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 8370 - DNA, 1136 bp, Shigella sp. FC2117
  ref <308>: DATABASE ACCESSION NUMBER: NCBI ACCESSION: NZ_MINP01000269.1
  ref <309>: DATABASE ENTRY DATE: 2019-04-01
  ref <313>: RELEVANT RESIDUES IN SEQ ID NO: (1)..(1136)
aaattgaagagtttgatcatggctcagattgaacgctggcggcaggcctaacacatgcaagtcgaacggtaacaggaatcagcttgctgattcgctgacgagtggcggacgggtgagtaatgtctgggaaactgcctgatggagggggataactactggaaacggtagctaataccgcataatgtcgcaagaccaaagagggggaccttcgggcctcttgccatcggatgtgcccagatgggattagcttgttggtggggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtc

SEQ ID NO: 8371 - DNA, 1554 bp, Shigella sp. FC2125; identical to SEQ ID NO: 8367
  ref <308>: DATABASE ACCESSION NUMBER: NCBI ACCESSION: NZ_MINQ01000237.1
  ref <309>: DATABASE ENTRY DATE: 2019-04-01
  ref <313>: RELEVANT RESIDUES IN SEQ ID NO: (1)..(1554)

SEQ ID NO: 8372 - DNA, 1554 bp, Shigella sp. FC2175; identical to SEQ ID NO: 8367
  ref <308>: DATABASE ACCESSION NUMBER: NCBI ACCESSION: NZ_MINR01000240.1
  ref <309>: DATABASE ENTRY DATE: 2019-04-01
  ref <313>: RELEVANT RESIDUES IN SEQ ID NO: (1)..(1554)

SEQ ID NO: 8373 - DNA, 1554 bp, Shigella sp. FC2710; identical to SEQ ID NO: 8365
  ref <308>: DATABASE ACCESSION NUMBER: NCBI ACCESSION: NZ_MINU01000252.1
  ref <309>: DATABASE ENTRY DATE: 2019-04-01
  ref <313>: RELEVANT RESIDUES IN SEQ ID NO: (1)..(1554)

SEQ ID NO: 8374 - DNA, 1554 bp, Shigella sp. FC2833; identical to SEQ ID NO: 8365
  ref <308>: DATABASE ACCESSION NUMBER: NCBI ACCESSION: NZ_MDJL01000249.1
  ref <309>: DATABASE ENTRY DATE: 2019-04-01
  ref <313>: RELEVANT RESIDUES IN SEQ ID NO: (1)..(1554)

SEQ ID NO: 8375 - DNA, 1554 bp, Shigella sp. FC2928; identical to SEQ ID NO: 8369
  ref <308>: DATABASE ACCESSION NUMBER: NCBI ACCESSION: NZ_MDDJ01000091.1
  ref <309>: DATABASE ENTRY DATE: 2019-04-01
  ref <313>: RELEVANT RESIDUES IN SEQ ID NO: (1)..(1554)

SEQ ID NO: 8376 - DNA, 1554 bp, Shigella sp. FC569
  ref <308>: DATABASE ACCESSION NUMBER: NCBI ACCESSION: NZ_MECV01000169.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaagcagcttgctgctttgctgacgagtggcggacgggtgagtaatgtctgggaaactgcccgatggagggggataactactggaaacggtggctaataccgcataacgtcgcaagaccaaagagggggaccttcgggcctcttgccatcggatgtgcccagatgggattagctagtaggtggggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 8377 - DNA, 1464 bp, Shigella sp. SHS-2
  ref <308>: DATABASE ACCESSION NUMBER: NCBI ACCESSION: NZ_PYKM01000277.1
  ref <309>: DATABASE ENTRY DATE: 2019-04-01
  ref <313>: RELEVANT RESIDUES IN SEQ ID NO: (1)..(1464)
ttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgacttggaggttgtgcccttgaggtgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 8378 - DNA, 1554 bp, Shigella sp. SHS-4
  ref <308>: DATABASE ACCESSION NUMBER: NCBI ACCESSION: NZ_PYKO01000308.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaatcagcttgctgattcgctgacgagtggcggacgggtgagtaatgtctgggaaactgcctgatggagggggataactactggaaacggtagctaataccgcataatgtcgcaagaccaaaaagggggaccttcgggcctcttgccatcagatgtgcccagatgggattagcttgttggtggggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttatccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggacgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 8379 - DNA, 226 bp, Shimazuella kribbensis
  misc_feature (198)..(198): n is a, c, g, or t
  ref <308>: DATABASE ACCESSION NUMBER: NCBI ACCESSION: NZ_KE386620.1
  ref <309>: DATABASE ENTRY DATE: 2019-04-01
  ref <313>: RELEVANT RESIDUES IN SEQ ID NO: (1)..(226)
acatgaagctggaatcgctagtaatcgcggatcagcatgccgcggtgaatacgttcccgggccttgtacacaccgcccgtcacaccacgagagtttgtaacacccgaagtcggtgacagaacccttaggggactgagctgccgaaggtgggacagatgattggggtgaagtcgtaacaaggtatccctaccggaaggnggggatggatcacctcctttctatggag

SEQ ID NO: 8380 - DNA, 1469 bp, Shimia abyssi
  ref <308>: DATABASE ACCESSION NUMBER: NCBI ACCESSION: NZ_PYGJ01000035.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcttaacacatgcaagtcgagcgcactcttcggagtgagcggcggacgggttagtaacgcgtgggaacataccttttggtaaggaatagcctctggaaacggagagtaataccttatacgccctttgggggaaagatttatcgccgagagattggcccgcgttagattagatagttggtggggtaacggcctaccaagtctacgatctatagctggttttagaggacgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggactattaagttaggggtgaaatcccggggctcaaccccggaactgcctctaatactggcagtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatctagagatagatggttcctttcggggacgcagtgacaggtgctgcatggctgtcgtcagctcgtgtcgtgagatgttcggttaagtccggcaacgagcgcaacccacatctttagttgccagcagttcggctgggcactctaaagaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaacctttcgaggaggcagcggaccacggtaggatcagcgactggggtgaagtcgtaacaaggtagccgtaggggaacctgcggctggatcacctcctttctaa

SEQ ID NO: 8381 - DNA, 1469 bp, Shimia aestuarii
  ref <308>: DATABASE ACCESSION NUMBER: NCBI ACCESSION: NZ_FOTQ01000009.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcgcccttcggggtgagcggcggacgggttagtaacgcgtgggaacatacctttcggtaaggaatagccactggaaacggtgagtaataccttatacgcccttcgggggaaagatttatcgccgagagattggcccgcgttagattagatagttggtggggtaatggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggattattaagttagaggtgaaatcccggggctcaaccccggaactgcctttaatactggtagtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatccagagatggatggttcccttcggggacgcagtgacaggtgctgcatggctgtcgtcagctcgtgtcgtgagatgttcggttaagtccggcaacgagcgcaacccacatctttagttgccagcagttcggctgggcactctaaagaaactgcccgtgataagcgggaggaaggtgtggatgacgtcaagtcctcatggcccttacgggttgggctacacacgtgctacaatggcagtgacaatgggttaatccctaaaaactgtctcagttcggattgtcgtctgcaactcgacggcatgaagtcggaatcgctagtaatcgcgtaacagcatgacgcggtgaatacgttcccgggccttgtacacaccgcccgtcacaccatgggagttggttctacccgacggccgtgcgctaacctttcgaggaggcagcggaccacggtaggatcagcgactggggtgaagtcgtaacaaggtagccgtaggggaacctgcggctggatcacctcctttctaa

SEQ ID NO: 8382 - DNA, 1465 bp, Shimia marina
  ref <308>: DATABASE ACCESSION NUMBER: NCBI ACCESSION: NZ_CYPW01000031.1
  ref <309>: DATABASE ENTRY DATE: 2019-04-01
  ref <313>: RELEVANT RESIDUES IN SEQ ID NO: (1)..(1465)
tcaacttgagagtttgatcctggctcagaacgaacgctggcggcaggcctaacacatgcaagtcgagcgcgcccttcggggtgagcggcggacgggttagtaacgcgtgggaacgtacccagatctacggaatagcctttggaaacgaagagtaataccgtatacgcccttcgggggaaagatttatcggatttggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcgggttgttaagttagaggtgaaatcccggggctcaaccccggaactgcctttaatactggcaacctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggacaactccagagatggagccttccttcgggacctagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatccccaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaaccttttggaggcagcggaccacggtaggatcagcgactggggtgaagtcgtaacaaggtagccgtaggggaacctgcggctggatcacctcctttctaa

SEQ ID NO: 8383 - DNA, 1470 bp, Shimia sp. SK013
  ref <308>: DATABASE ACCESSION NUMBER: NCBI ACCESSION: NZ_LAJH01000015.1
  ref <309>: DATABASE ENTRY DATE: 2019-04-01
  ref <313>: RELEVANT RESIDUES IN SEQ ID NO: (1)..(1470)
tcaacttgagagtttgatcctggctcagaacgaacgctggcggcaggcttaacacatgcaagtcgagcgcactcttcggagtgagcggcggacgggttagtaacgcgtgggaacatacctttctctaaggaatagcctctggaaacggagagtaataccttatacgcccctcgggggaaagatttatcggagagagattggcccgcgttagattagatagttggtggggtaatggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgtacgtaggcgggttgttaagttagaggtgaaatcccagggctcaaccctggaactgcctttaatactggcaacctagagttcgagagaggtgagtggaattccgagtgtagaggtgaaattcgtagatattcggaggaacaccagtggcgaaggcggctcactggctcgatactgacgctgaggtacgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccgccagagagatttggctttcacttcggtgacctagtgacaggtgctgcatggctgtcgtcagctcgtgtcgtgagatgttcggttaagtccggcaacgagcgcaacccacatccttagttgccagcaggttaagctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaactcttcggaggggcagcggaccacggtaggatcagcgactggggtgaagtcgtaacaaggtagccgtaggggaacctgcggctggatcacctcctttctaa

SEQ ID NO: 8384 - DNA, 1550 bp, Shimwellia blattae
  ref <308>: DATABASE ACCESSION NUMBER: NCBI ACCESSION: NZ_LR134215.1
  ref <309>: DATABASE ENTRY DATE: 2019-04-01
  ref <313>: RELEVANT RESIDUES IN SEQ ID NO: (1)..(1550)
aattgaagagtttgatcatggctcagattgaacgctggcggcaggcttaacacatgcaagtcgaacggtaacagaaatcagcttgctgatttgctgacgagtggcggacgggtgagtaatgtctgggaaactgcctgatggagggggataactactggaaacggtagctaataccgcataatgtcgcaagaccaaagtgggggaccttcgggcctcataccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcagcaattgacgttacccgcagaagaagcaccggctaactccgtgccagcagccgcggtaatacggagggtgcaagcgttaatcggaattactgggcgtaaagcgcacgcaggcggttgattaagtcagatgtgaaatccccgggcttaacctgggaactgcatttgaaactggtcagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcaacttggaagttgtgcccttgaggcgtggcttccggagctaacgcgttaagttgaccgcctggggagtacggccgcaaggttaaaactcaaatgaattgacgggggcccgcacaagcggtggagcatgtggtttaattcgatgcaacgcgaagaaccttacctggtcttgacatccatagaacttggcagagatgccttggtgccttcgggagctatgagacaggtgctgcatggctgtcgtcagctcgtgttgtgaaatgttgggttaagtcccgcaacgagcgcaacccctatcctctgttgccagcacttcgggtgggaactcaggggagactgccagtgataaactggaggaaggtggggatgacgtcaagtcatcatggcccttacgaccagggctacacacgtgctacaatggcgcatacaaagagaagcgacctcgcgagagcaagcggatctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaaga

SEQ ID NO: 8385 - DNA, 808 bp, Shinella sp. DD12
  ref <308>: DATABASE ACCESSION NUMBER: NCBI ACCESSION: NZ_AYLZ02000072.1
  ref <309>: DATABASE ENTRY DATE: 2019-04-01
  ref <313>: RELEVANT RESIDUES IN SEQ ID NO: (1)..(808)
ttactgacgctgaggtgcgaaagcgtggggagcaaacaggattagataccctggtagtccacgccgtaaacgatgaatgttagccgtcggcatgcatgcatgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtcggtcgcggattacagagatgttttccttcagttaggctggaccgaacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgatgcgctaaccgcaaggaggcagtcgaccacggtagggtcagcgactggggtgaagtcgtaacaaggtagccgtaggggaacctgcggctggatcacctcctttctaaggaagc

SEQ ID NO: 8386 - DNA, 1496 bp, Shinella sp. HZN7
  ref <308>: DATABASE ACCESSION NUMBER: NCBI ACCESSION: NZ_CP015736.1
  ref <309>: DATABASE ENTRY DATE: 2019-04-01
  ref <313>: RELEVANT RESIDUES IN SEQ ID NO: (1)..(1496)
tcaacatgagagtttgatcctggctcagaacgaacgctggcggcaggcttaacacatgcaagtcgaacgcatcgcaagatgagtggcagacgggtgagtaacgcgtgggaacgtaccctttactacggaataactcagggaaacttgtgctaataccgtatgtgcccttcgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcgggtatttaagtcaggggtgaaatcccggagctcaactccggaactgcctttgatactgggtacctagagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcggcatgcatgcatgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtcggtcgcggtttccagagatggataccttcagttaggctggaccgaacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgatgcgctaaccgcaaggaggcagtcgaccacggtagggtcagcgactggggtgaagtcgtaacaaggtagccgtaggggaacctgcggctggatcacctcctttctaaggaagc

SEQ ID NO: 8387 - DNA, 1496 bp, Shinella sp. SUS2
  ref <308>: DATABASE ACCESSION NUMBER: NCBI ACCESSION: NZ_KQ410739.1
  ref <309>: DATABASE ENTRY DATE: 2019-04-01
  ref <313>: RELEVANT RESIDUES IN SEQ ID NO: (1)..(1496)
tcaacatgagagtttgatcctggctcagaacgaacgctggcggcaggcttaacacatgcaagtcgaacgccccgcaaggggagtggcagacgggtgagtaacgcgtgggaacgtaccctttactacggaataactcagggaaacttgtgctaataccgtatgtgcccttcgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcgggtatttaagtcaggggtgaaatcccagagctcaactctggaactgcctttgatactgggtacctagagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcggcatgcatgcatgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtcggtcgcggattacagagatgttttccttcagttaggctggaccgaacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgatgcgctaaccgcaaggaggcagtcgaccacggtagggtcagcgactggggtgaagtcgtaacaaggtagccgtaggggaacctgcggctggatcacctcctttctaaggaagc

SEQ ID NO: 8388 - DNA, 1491 bp, Shinella sp. WSJ-2
  ref <308>: DATABASE ACCESSION NUMBER: NCBI ACCESSION: NZ_QWBU01000027.1
  ref <309>: DATABASE ENTRY DATE: 2019-04-01
  ref <313>: RELEVANT RESIDUES IN SEQ ID NO: (1)..(1491)
tcaacatgagagtttgatcctggctcagaacgaacgctggcggcaggcttaacacatgcaagtcgaacgccccgcaaggggagtggcagacgggtgagtaacgcgtgggaacgtaccctttactacggaataactcagggaaacttgtgctaataccgtatgtgcccttcgggggaaagatttatcggtaaaggatcggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcgggtatttaagtcaggggtgaaatcccagagctcaactctggaactgcctttgatactgggtacctagagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcggcatgcatgcatgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtcggtcgcggattacagagatgttttccttcagttaggctggaccgaacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcactgcgctaaccgcaagggggcaggtgaccacggtagggtcagcgactggggtgaagtcgtaacaaggtagccgtaggggaacctgcggctggatcacctcctttctaag

SEQ ID NO: 8389 - DNA, 1491 bp, Shinella zoogloeoides
  ref <308>: DATABASE ACCESSION NUMBER: NCBI ACCESSION: NZ_QNUJ01000022.1
  ref <309>: DATABASE ENTRY DATE: 2019-04-01
  ref <313>: RELEVANT RESIDUES IN SEQ ID NO: (1)..(1491)
tcaacatgagagtttgatcctggctcagaacgaacgctggcggcaggcttaacacatgcaagtcgaacgccccgcaaggggagtggcagacgggtgagtaacgcgtgggaatctacccatctctacggaataactcagggaaacttgtgctaataccgtatacgcccttcgggggaaagatttatcggagatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcgggtatttaagtcaggggtgaaatcccggagctcaactccggaactgcctttgatactgggtacctagagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcggcatgcatgcatgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatgtcggtcgcggattacagagatgttttccttcagttaggctggaccgaacacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgatgcgctaaccgcaaggaggcagtcgaccacggtagggtcagcgactggggtgaagtcgtaacaaggtagccgtaggggaacctgcggctggatcacctcctttctaag

SEQ ID NO: 8390 - DNA, 1456 bp, Siccibacter turicensis
  ref <308>: DATABASE ACCESSION NUMBER: NCBI ACCESSION: NZ_RYYT01000020.1
  ref <309>: DATABASE ENTRY DATE: 2019-04-01
  ref <313>: RELEVANT RESIDUES IN SEQ ID NO: (1)..(1456)
gctgacgagtggcggacgggtgagtaatgtctggggatctgcctgatggagggggataactactggaaacggtagctaataccgcataacgtcgcaagaccaaagagggggaccttcgggcctcttgccatcagatgaacccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggyggtaaggttaataaccttatcrattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgtatacaaagagaagcgaactcgcgagagcaagcggacctcataaagtacgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaaa

SEQ ID NO: 8391 - DNA, 1467 bp, Silicibacter sp. TrichCH4B; identical to SEQ ID NO: 3673
  ref <308>: DATABASE ACCESSION NUMBER: NCBI ACCESSION: NZ_GG703519.1
  ref <309>: DATABASE ENTRY DATE: 2019-04-01
  ref <313>: RELEVANT RESIDUES IN SEQ ID NO: (1)..(1467)

SEQ ID NO: 8392 - DNA, 1470 bp, Silicimonas algicola
  ref <308>: DATABASE ACCESSION NUMBER: NCBI ACCESSION: NZ_CP034588.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcaggcctaacacatgcaagtcgagcgcaccttcgggtgagcggcggacgggttagtaacgcgtgggaacgtgcccttctctacggaatagcctcgggaaactgagagtaataccgtatacgccctttgggggaaagatttatcggagaaggatcggcccgcgttggattaggtagttggtggggtaatggcctaccaagccgacgatccatagctggtttgagaggatgatcagcaacactgggactgagacacggcccagactcctacgggaggcagcagtggggaatcttagacaatgggggaaaccctgatctagccatgccgcgtgagtgacgaaggccttagggtcgtaaagctctttcagctgtgaagataatgacggtagcagcagaagaaaccccggctaactccgtgccagcagccgcggtaatacggagggggttagcgttgttcggaattactgggcgtaaagcgcgcgtaggcgaactattaagtcagaggtgaaatcccagggctcaaccctggaactgcctttgatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcggctcgcatgcgggtcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatacctgtcgtagttaccagagatggtttcgtcagttcggctggacaggatacaggtgctgcatggctgtcgtcagctcgtgtcgtgagatgttcggttaagtccggcaacgagcgcaacccacatccttagttgccagcaggttaagctgggcactctagggaaactgcccgtgataagcgggaggaaggtgtggatgacgtcaagtcctcatggcccttacgggttgggctacacacgtgctacaatggcatctacagtgggttaatccccaaaagatgtctcagttcggattgtcgtctgcaactcgacggcatgaagtcggaatcgctagtgatcgcggaacagcatgccgcggtgaatacgttcccgggccttgtacacaccgcccgtcacaccatgggagttggttctacccgacgatggtgcgctaaccttcacaggaggcagccagccacggtaggatcagcgactggggtgaagtcgtaacaaggtagccgtaggggaacctgcggctggatcacctcctttctaa

SEQ ID NO: 8393 - DNA, 1479 bp, Simiduia agarivorans; identical to SEQ ID NO: 3417
  ref <308>: DATABASE ACCESSION NUMBER: NCBI ACCESSION: NZ_QWEZ01000005.1
  ref <309>: DATABASE ENTRY DATE: 2019-04-01
  ref <313>: RELEVANT RESIDUES IN SEQ ID NO: (1)..(1479)

SEQ ID NO: 8394 - DNA, 1556 bp, Simkania negevensis
  ref <308>: DATABASE ACCESSION NUMBER: NCBI ACCESSION: NC_015713.1
  ref <309>: DATABASE ENTRY DATE: 2019-04-01
  ref <313>: RELEVANT RESIDUES IN SEQ ID NO: (1)..(1556)
tttattgagaatttgatcctggttcagattgaatgctgacggcgtggatgaggcatgcaagtcgaacgaagtagtaacttgttactacttagtggcgaaagggttagtaatacatgagtaacttacctcttacctggggataacggttggaaacgaccgctaataccgaatgaggagagctggggtagcctggtttcttcaaagttggggattctgcaaagaaccttgcggtaggagagaggctcatgggatatcagcttgttggtgtggtaaaggcgcaccaaggctaagacgtctaggcgggctgagaggttgaccgccaacactgggactgagacactgcccagactcctacgggaggctgcagtcgagaatcattcgcaatgggcgaaagcctgacgatgcgacgccgtgtgaacgatgaaggccttcgggttgtaaagttctttcgctaaggaacaagaaaaggtaacgaataattgcctaatttgagggtacttggtaaagaagcaccggctaactccgtgccagcagctgcggtaatacggagggtgcaagcattaatcggatttactgggtgtaaagggcgcgtaggcgggtaagcaagtcagatgtgaaattccggagctcaactccggagctgcatttgaaactacttatcttgagggtggacggagaaaacggaattccacgtgtagcggtgaaatgcgtagatatgtggaagaacaccggtggcgaaggcggttttctagttcattcctgacgctgaggcgcgagagcaaggggagcaaacaggattagataccctggtagtccttgctgtaaacactgcatacttggtgtagtcggtctcaaccccgactgtgccgtagctaacgcgttaagtatgccacctggggagtacgctcgcaagggtgaaactcaaaagaattgacgggggcccgcacaagcagtggagcatgtggtttaattcgatgcaacgcgaagaaccttacccaggcttgacatttagaggaccgcatcagagatgatgtttcccgcaagggcctcttgacaggtgctgcatggctgtcgtcagctcgtgccgtgaggtgttgggttaagtcccgcaacgagcgcaacccttgtcgctagttaccagcacgtaatggtggggactctagcgagactgcctaggttaactaggaggaaggtgaggatgacgtcaagtccgcatggcctttatgtctggggctacacacgtgctacaatggtcggtacagaaggcagcgaagccgaaaggtgaagcaaatcccaaaagccgatcccagttcggattgaagtctgcaactcgacttcatgaagttggaattgctagtaatgacgtgtcagcaataacgtcgtgaatacgttcccgggccttgtacacaccgcccgtcacatcatggaagttggttttacccgaagtcgtcgactcaaccgcaaggagagagacgccgaaggtagggctgatgactgggatgaagtcgtaacaaggtagccgtaccggaaggtgcggctggatcacctcctttaag

SEQ ID NO: 8395 - DNA, 1126 bp, Simplicispira metamorpha; identical to SEQ ID NO: 6258
  ref <308>: DATABASE ACCESSION NUMBER: NCBI ACCESSION: NZ_QXNC01000059.1
  ref <309>: DATABASE ENTRY DATE: 2019-04-01
  ref <313>: RELEVANT RESIDUES IN SEQ ID NO: (1)..(1126)

SEQ ID NO: 8396 - DNA, 1541 bp, Simplicispira sp. 110
  ref <308>: DATABASE ACCESSION NUMBER: NCBI ACCESSION: NZ_QUMV01000001.1
  ref <309>: DATABASE ENTRY DATE: 2019-04-01
  ref <313>: RELEVANT RESIDUES IN SEQ ID NO: (1)..(1541)
agatcgaactgtagagtttgatcctggctcagattgaacgctggcggcatgccttacacatgcaagtcgaacggtaacagcactttggtggctgacgagtggcggacgggtgagtaatacatcggaacgtgcccgatcgtgggggataactactcgaaagagtggctaataccgcatacgatctacggatgaaagcgggggatcgcaagacctcgcgcggacggagcggccgatggcagattaggtagttggtgggataaaagcttaccaagccgacgatctgtagctggtctgagaggacgaccagccacactgggactgagacacggcccagactcctacgggaggcagcagtggggaattttggacaatgggggaaaccctgatccagccatgccgcgtgcaggatgaaggccttcgggttgtaaactgcttttgtacggaacgaaaagactctttctaatacagagggtccatgacggtaccgtaagaataagcaccggctaactacgtgccagcagccgcggtaatacgtagggtgcaagcgttaatcggaattactgggcgtaaagcgtgcgcaggcggttatataagacagatgtgaaatccccgggctcaacctgggaactgcattagtgactgtatagctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggaatttactttctcagtaacgaagctaacgcgtgaagttgaccgcctggggagtacggccgcaaggttaaaactcaaaggaattgacggggacccgcacaagcggtggatgatgtggtttaattcgatgcaacgcgaaaaaccttacccacctttgacatgtatggaagatcgcagagacgcgattgtgcttgaaagagagccataacacaggtgctgcatggctgtcgtcagctcgtgtcgtgagatgttgggttaagtcccgcaacgagcgcaacccttgccattagttgctacatttagttgggcactctaatgggactgccggtgacaaaccggaggaaggtggggatgacgtcaagtcctcatggcccttataggtggggctacacacgtcatacaatggctggtacaaagggttgccaacccgcgagggggagctaatcccataaagccagtcgtagtccggatcgtagtctgcaactcgactacgtgaagtcggaatcgctagtaatcgtggatcagaatgtcacggtgaatacgttcccgggtcttgtacacaccgcccgtcacaccatgggagcgggtctcgccagaagtagttagcctaaccgcaaggagggcgattaccacggcggggttcgtgactggggtgaagtcgtaacaaggtagccgtatcggaaggtgcggctggatcacctcctttctg

SEQ ID NO: 8397 - DNA, 1541 bp, Simplicispira sp. 125; identical to SEQ ID NO: 8396
  ref <308>: DATABASE ACCESSION NUMBER: NCBI ACCESSION: NZ_QEKM01000001.1
  ref <309>: DATABASE ENTRY DATE: 2019-04-01
  ref <313>: RELEVANT RESIDUES IN SEQ ID NO: (1)..(1541)

SEQ ID NO: 8398 - DNA, 1537 bp, Simplicispira sp. CPCC 100842
  ref <308>: DATABASE ACCESSION NUMBER: NCBI ACCESSION: NZ_QXGR01000022.1
  ref <309>: DATABASE ENTRY DATE: 2019-04-01
  ref <313>: RELEVANT RESIDUES IN SEQ ID NO: (1)..(1537)
agatcgaactgaagagtttgatcctggctcagattgaacgctggcggcatgccttacacatgcaagtcgaacggtaacaggtcttcggatgctgacgagtggcgaacgggtgagtaatacatcggaacgtgcccgatcgtgggggataacgcagcgaaagctgtgctaataccgcatacgatctacggatgaaagcgggggatcgcaagacctcgcgcggacggagcggccgatggcagattaggtagttggtgggataaaagcttaccaagccgacgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaaagttctctctaatacagggggcgaatgacggtaccgtaagaataagcaccggctaactacgtgccagcagccgcggtaatacgtagggtgcgagcgttaatcggaattactgggcgtaaagcgtgcgcaggcggtgatgtaagacagatgtgaaatccccgggctcaacctgggaactgcatttgtgactgcatcgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggccttcactggctcagtaacgaagctaacgcgtgaagttgaccgcctggggagtacggccgcaaggttaaaactcaaaggaattgacggggacccgcacaagcggtggatgatgtggtttaattcgatgcaacgcgaaaaaccttacccacctttgacatgtacggaagatcgcagagacgcgattgtgctcgaaagagaaccgtaacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggctggtacaaagggttgccaacccgcgagggggagctaatcccataaagccagtcgtagtccggatcgtagtctgcaactcgactacgtgaagtcggaatcgctagtaatcgtggatcagaatgtcacggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctg

SEQ ID NO: 8399 - DNA, 1536 bp, Simplicispira sp. NY-02
  ref <308>: DATABASE ACCESSION NUMBER: NCBI ACCESSION: NZ_QXJC01000016.1
  ref <309>: DATABASE ENTRY DATE: 2019-04-01
  ref <313>: RELEVANT RESIDUES IN SEQ ID NO: (1)..(1536)
gaactgtagagtttgatcctggctcagattgaacgctggcggcatgccttacacatgcaagtcgaacggtaacagcacttcggtggctgacgagtggcgaacgggtgagtaatacatcggaacgtgcccgagagtgggggataacgcagcgaaagctgtgctaataccgcatacgatctacggatgaaagcaggggaccgcaaggccttgcgctcacggagcggccgatggcagattaggtagttggtgggataaaagcttaccaagccgacgatctgtagctggtctgagaggacgaccagccacactgggactgagacacggcccagactcctacgggaggcagcagtggggaattttggacaatgggcgaaagcctgatccagccatgccgcgtgcaggatgaaggccttcgggttgtaaactgcttttgtacggaacgaaaaggtcttttctaataaagaaggctcatgacggtaccgtaagaataagcaccggctaactacgtgccagcagccgcggtaatacgtagggtgcaagcgttaatcggaattactgggcgtaaagcgtgcgcaggcggttatataagacagatgtgaaatccccgggctcaacctgggaactgcattagtgactgtatagctagagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggaatttactttctcagtaacgaagctaacgcgtgaagttgaccgcctggggagtacggccgcaaggttaaaactcaaaggaattgacggggacccgcacaagcggtggatgatgtggtttaattcgatgcaacgcgaaaaaccttacccacctttgacatgtatggaagatcgcagagacgcgattgtgctcgaaagagagccataacacaggtgctgcatggctgtcgtcagctcgtgtcgtgagatgttgggttaagtcccgcaacgagcgcaacccttgtcattagttgctacatttagttgggcactctaatgagactgccggtgacaaaccggaggaaggtggggatgacgtcaagtcctcatggcccttataggtggggctacacacgtcatacaatggctggtacaaagggttgccaacccgcgagggggagccaatcccataaagccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtaggtagcctaaccgtaaggagggcgcttaccacggcagggttcgtgactggggtgaagtcgtaacaaggtagccgtatcggaaggtgcggctggatcacctcctttctg

SEQ ID NO: 8400 - DNA, 1543 bp, Simplicispira suum
  ref <308>: DATABASE ACCESSION NUMBER: NCBI ACCESSION: NZ_CP027669.1
  ref <309>: DATABASE ENTRY DATE: 2019-04-01
  ref <313>: RELEVANT RESIDUES IN SEQ ID NO: (1)..(1543)
agatcgaactgtagagtttgatcctggctcagattgaacgctggcggcatgccttacacatgcaagtcgaacggtaacagcacttcggtggctgacgagtggcgaacgggtgagtaatacatcggaacgtgcccgagagtgggggataacgcagcgaaagctgtgctaataccgcatacgatctacggatgaaagcaggggattcgcaaggaccttgcgctcatggagcggccgatggcagattaggtagttggtgggataaaagcttaccaagccgacgatctgtagctggtctgagaggacgaccagccacactgggactgagacacggcccagactcctacgggaggcagcagtggggaattttggacaatgggcgaaagcctgatccagccatgccgcgtgcaggatgaaggccttcgggttgtaaactgcttttgtacggaacgaaaagatctcttctaataaagggggtccatgacggtaccgtaagaataagcaccggctaactacgtgccagcagccgcggtaatacgtagggtgcaagcgttaatcggaattactgggcgtaaagcgtgcgcaggcggttatataagacagatgtgaaatccccgggctcaacctgggaactgcattagtgactgtatagctagagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggaatttactttctcagtaacgaagctaacgcgtgaagttgaccgcctggggagtacggccgcaaggttaaaactcaaaggaattgacggggacccgcacaagcggtggatgatgtggtttaattcgatgcaacgcgaaaaaccttacccacctttgacatgtatggaagactgcagagacgcagttgtgctcgaaagagagccataacacaggtgctgcatggctgtcgtcagctcgtgtcgtgagatgttgggttaagtcccgcaacgagcgcaacccttgtcattagttgctacatttagttgggcactctaatgagactgccggtgacaaaccggaggaaggtggggatgacgtcaagtcctcatggcccttataggtggggctacacacgtcatacaatggctggtacaaagggttgccaacccgcgagggggagccaatcccacaaagccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtaggtagcctaaccgcaaggagggcgcttaccacggcagggttcgtgactggggtgaagtcgtaacaaggtagccgtatcggaaggtgcggctggatcacctcctttctg

SEQ ID NO: 8401 - DNA, 1531 bp, Sinimarinibacterium flocculans
  ref <308>: DATABASE ACCESSION NUMBER: NCBI ACCESSION: NZ_QICN01000002.1
  ref <309>: DATABASE ENTRY DATE: 2019-04-01
  ref <313>: RELEVANT RESIDUES IN SEQ ID NO: (1)..(1531)
aaagtggagagtttgatcctggctcagattgaacgctggcggcatgcctaacacatgcaagtcgaacgaggtgtagcaatacacctagtggcggacgggtgagtaatacgtaggaatctgcctcagagtgggggatagcccggggaaactcggattaataccgcatgatctcgcaagagcaaagcaggggaccgcaaggccttgtgctctgagaggagcctacgtctgattagctagttggcggggtaatggcccaccaaggcgacgatcagtaactggtctgagaggacgatcagtcacaccggaactgagacacggtccggactcctacgggaggcagcagtggggaatattggacaatgggcgaaagcctgatccagcaatgccgcgtgtgtgaagaaggccttcgggttgtaaagcactttagtcagggaagaaaaagctcaagctaatatcttgagtgttgacggtacctgaagaataagcaccggctaactctgtgccagcagccgcggtaatacagagggtgcgagcgttaatcggatttactgggcgtaaagcgtgtgtaggtggctgttcaagtcggttgtgaaatccccgggctcaacctgggaattgcttccgagactgagcggctagagtacggtagagggcggtggaatttccggtgtagcggtgaaatgcgtagatatcggaaggaacaccaatggcgaaggcagccgcctgggcctgtactgacactgagacacgaaagcgtggggatcaaacaggattagataccctggtagtccacgccgtaaacgatgagaacttgacgtcggcatgctctgcgtgtcggtgtcgtagctaacgcgataagttctccgcctggggagtacggccgcaaggttgaaactcaaaggaattgacgggggcccgcacaagcggtggagtatgtggtttaattcgatgcaacgcgaagaaccttacctggccttgacatgctcggaagcctgcagagatgcgggtgtgcccgcaagggaaccgagacacaggtgctgcatggctgtcgtcagctcgtgtcgtgagatgttgggttaagtcccgcaacgagcgcaacccttgcccttagttgcccccattcagttgagcactctaaggggaccgccggtgacaaaccggaggaaggtggggatgacgtcaagtcatcatggcccttatggccagggctacacacgtactacaatgggcagtacagagggtcgccaacccgcgagggggagctaatcccagaaagctgttcgtagtccggatcggagtctgcaactcgactccgtgaagtcggaatcgctagtaatcgccgatcagcatttgcggcggtgaatacgttcccgggccttgtacacaccgcccgtcacaccatggaagtctgttgcaccagaagtgggtagtctaaccgcaaggagggcgcctaccacggtgtggccgatgactggggtgaagtcgtaacaaggtagccgtaggggaacctgcggctggatcacctccttta

SEQ ID NO: 8402 - DNA, 1476 bp, Sinirhodobacter ferrireducens
  ref <308>: DATABASE ACCESSION NUMBER: NCBI ACCESSION: NZ_SAVB01000036.1
  ref <309>: DATABASE ENTRY DATE: 2019-04-01
  ref <313>: RELEVANT RESIDUES IN SEQ ID NO: (1)..(1476)
ggtttcaacttgagagtttgatcctggctcagaacgaacgctggcggcaggcctaacacatgcaagtcgagcgagatcttcggatctagcggcggacgggtgagtaacgcgtgggaacgtaccctttgcttcggaatagcctcgggaaactgggagtaataccgaatgtgccctacgggggaaagatttatcggcaaaggatcggcccgcgttggattaggtagttggtgaggtaatggctcaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggattattaagtcgggggtgaaatcccggggctcaaccccggaactgccttcgatactggtagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcgagatcgcggttaccagagatggtttccttcagttcggctggatctcagacaggtgctgcatggctgtcgtcagctcgtgtcgtgagatgttcggttaagtccggcaacgagcgcaacccacgtcttcagttgccagcattcagttgggcactctgaagaaactgccgatgataagtcggaggaaggtgtggatgacgtcaagtcctcatggcccttacgggttgggctacacacgtgctacaatggcgatgacaatgggccaatcccaaaaagtcgtctcagttcggattggggtctgcaactcgaccccatgaagtcggaatcgctagtaatcgcgtaacagcatgacgcggtgaatacgttcccgggccttgtacacaccgcccgtcacaccatgggaattgggtctaccctaagatggtgcgccaacctgtaaaggaggcagccagccacggtaggctcagtgactggggtgaagtcgtaacaaggtagccgtaggggaacctgcggctggatcacctcctttctaa

SEQ ID NO: 8403 - DNA, 1471 bp, Sinirhodobacter sp. 07D10-4-3
  ref <308>: DATABASE ACCESSION NUMBER: NCBI ACCESSION: NZ_SAUY01000069.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgaacccttcggggttagcggcggacgggtgagtaacgcgtgggaacgtgccctttgctacggaatagccccgggaaactgggagtaataccgtatgtgcccttcgggggaaagatttatcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggaccagaaagttgggggtgaaatcccggggctcaaccccggaactgccttcaaaactgctggtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcgggatcgcggttaccggagacggtttccttcagttcggctggatcctggacaggtgctgcatggctgtcgtcagctcgtgtcgtgagatgttcggttaagtccggcaacgagcgcaacccacgtctttagttgccagcattcagttgggcactctaaagaaactgccgatgataagtcggaggaaggtgtggatgacgtcaagtcctcatggcccttacgggttgggctacacacgtgctacaatggcgatgacaatgggttaatcccaaaaaatcgtctcagttcggattggggtctgcaactcgaccccatgaagtcggaatcgctagtaatcgcgtaacagcatgacgcggtgaatacgttcccgggccttgtacacaccgcccgtcacaccatgggaattgggtctaccctaagatggtgcgccaaccagcaatggaggcagccagccacggtaggctcagtgactggggtgaagtcgtaacaaggtagccgtaggggaacctgcggctggatcacctcctttctaa

SEQ ID NO: 8404 - DNA, 1471 bp, Sinirhodobacter sp. 24D10-4-9
  ref <308>: DATABASE ACCESSION NUMBER: NCBI ACCESSION: NZ_SAUV01000046.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgaacccttcggggttagcggcggacgggtgagtaacgcgtgggaacgtgccctttgctacggaatagccccgggaaactgggagtaataccgtatgtgccctttgggggaaagatttatcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggaccagaaagttgggggtgaaatcccggggctcaaccccggaactgccttcaaaactgttggtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcgggatcgcggttaccggagacggtttccttcagttcggctggatcctggacaggtgctgcatggctgtcgtcagctcgtgtcgtgagatgttcggttaagtccggcaacgagcgcaacccacgtctttagttgccagcattcagttgggcactctaaagaaactgccgatgataagtcggaggaaggtgtggatgacgtcaagtcctcatggcccttacgggttgggctacacacgtgctacaatggcgatgacaatgggttaatcccaaaaaatcgtctcagttcggattggggtctgcaactcgaccccatgaagtcggaatcgctagtaatcgcgtaacagcatgacgcggtgaatacgttcccgggccttgtacacaccgcccgtcacaccatgggaattgggtctaccctaagatggtgcgccaaccagcaatggaggcagccagccacggtaggctcagtgactggggtgaagtcgtaacaaggtagccgtaggggaacctgcggctggatcacctcctttctaa

SEQ ID NO: 8405 - DNA, 1471 bp, Sinirhodobacter sp. 2D-5; identical to SEQ ID NO: 8404
  ref <308>: DATABASE ACCESSION NUMBER: NCBI ACCESSION: NZ_SAUW01000055.1
  ref <309>: DATABASE ENTRY DATE: 2019-04-01
  ref <313>: RELEVANT RESIDUES IN SEQ ID NO: (1)..(1471)

SEQ ID NO: 8406 - DNA, 1473 bp, Sinirhodobacter sp. CGMCC 1.12963
  ref <308>: DATABASE ACCESSION NUMBER: NCBI ACCESSION: NZ_SAVA01000025.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcaggcctaacacatgcaagtcgagcgagatcttcggatctagcggcggacgggtgagtaacgcgtgggaacgtaccctttgcttcggaatagcctcgggaaactgggagtaataccgaatgtgccctacgggggaaagatttatcggcaaaggatcggcccgcgttggattaggtagttggtgaggtaatggctcaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggattagtcagtcagaggtgaaatcccagggctcaaccctggaactgcctttgatactgctagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcgggatcgcggtttccagagatggattccttcagttcggctggatcccagacaggtgctgcatggctgtcgtcagctcgtgtcgtgagatgttcggttaagtccggcaacgagcgcaacccacgtctttagttgccagcattcagttgggcactctaaagaaactgccgatgataagtcggaggaaggtgtggatgacgtcaagtcctcatggcccttacgggttgggctacacacgtgctacaatggcgatgacaatgggccaatcccaaaaaatcgtctcagttcggattggggtctgcaactcgaccccatgaagtcggaatcgctagtaatcgcgtaacagcatgacgcggtgaatacgttcccgggccttgtacacaccgcccgtcacaccatgggaattgggtctaccctaagatggtgcgccaacctggtaacaggaggcagccagccacggtaggctcagtgactggggtgaagtcgtaacaaggtagccgtaggggaacctgcggctggatcacctcctttctaa

SEQ ID NO: 8407 - DNA, 1471 bp, Sinirhodobacter sp. D19-10-3-21
  ref <308>: DATABASE ACCESSION NUMBER: NCBI ACCESSION: NZ_SAUX01000050.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgaacccttcggggttagcggcggacgggtgagtaacgcgtgggaacgtgccctttgctacggaatagccccgggaaactgggagtaataccgtatgtgccctttgggggaaagatttatcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggaccagaaagttgggggtgaaatcccggggctcaaccccggaactgccttcaaaactgctggtcttgaggtcgagagaggtgagtggaattccgagtgtagaggtgaaattcgtagatattcggaggaacatcagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcgggatcgcggttaccggagacggtttccttcagttcggctggatcctggacaggtgctgcatggctgtcgtcagctcgtgtcgtgagatgttcggttaagtccggcaacgagcgcaacccacgtctttagttgccagcattcagttgggcactctaaagaaactgccgatgataagtcggaggaaggtgtggatgacgtcaagtcctcatggcccttacgggttgggctacacacgtgctacaatggcgatgacaatgggttaatcccaaaaaatcgtctcagttcggattggggtctgcaactcgaccccatgaagtcggaatcgctagtaatcgcgtaacagcatgacgcggtgaatacgttcccgggccttgtacacaccgcccgtcacaccatgggaattgggtctaccctaagatggtgcgccaaccagcaatggaggcagccagccacggtaggctcagtgactggggtgaagtcgtaacaaggtagccgtaggggaacctgcggctggatcacctcctttctaa

SEQ ID NO: 8408 - DNA, 1471 bp, Sinirhodobacter sp. SK2B-1
  ref <308>: DATABASE ACCESSION NUMBER: NCBI ACCESSION: NZ_SAUZ01000056.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgaacccttcggggttagcggcggacgggtgagtaacgcgtgggaacgtgccctttgctacggaatagccccgggaaactgggagtaataccgtatgtgccctttgggggaaagatttatcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggaccagaaagttgggggtgaaatcccggggctcaaccccggaactgccttcaaaactgctggtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcgggatcgcggttaccggagacggtttccttcagttcggctggatcctggacaggtgctgcatggctgtcgtcagctcgtgtcgtgagatgttcggttaagtccggcaacgagcgcaacccacgtctttagttgccagcattcagttgggcactctaaagaaactgccgatgataagtcggaggaaggtgtggatgacgtcaagtcctcatggcccttacgggttgggctacacacgtgctacaatggcgatgacaatgggttaatcccaaaaaatcgtctcagttcggattggggtctgcaactcgaccccatgaagtcggaatcgctagtaatcgcgtaacagcatgacgcggtgaatacgttcccgggccttgtacacaccgcccgtcacaccatgggaattgggtctaccctaagatggtgcgccaaccagcaatggaggcagccagccacggtaggctcagtgactggggtgaagtcgtaacaaggtagccgtaggggaacctgcggctggatcacctcctttctaa

SEQ ID NO: 8409 - DNA, 1477 bp, Sinobaca qinghaiensis
  ref <308>: DATABASE ACCESSION NUMBER: NCBI ACCESSION: NZ_RAPK01000004.1
  ref <309>: DATABASE ENTRY DATE: 2019-04-01
  ref <313>: RELEVANT RESIDUES IN SEQ ID NO: (1)..(1477)
aaaccggggaattgagcggcggacgggtgagtaacacgtgggcaacctgccctctagacggggataactccgggaaaccggagctaatacccgataatcaagcagatcacctgatctgcttgtaaaagcatggccttcgggccatgcactggaggatgggcccgcggcgtattagctagttggagaggtaagggctccccaaggcgacgatacgtagccgacctgagagggtgatcggccacactgggactgagacacggcccagactcctacgggaggcagcagtagggaatcatccgcaatggacgaaagtctgacggtgcaacgccgcgtgagtgatgaaggttttcggatcgtaaagctctgttgtgagggaagaacaagggcggttctaacagggccgccccctgacggtacctcaccagaaagccccggctaactacgtgccagcagccgcggtaatacgtagggggcaagcgttgtccggaattattgggcgtaaagcgcgcgcaggcggttccttaagtctgatgtgaaagcccacggctcaaccgtggagggtcattggaaactggggaactggaatgcagaagaggagagtggaattccacgtgtagcggtgaaatgcgtagatatgtggaggaacaccagtggcgaaggcggctctctggtctgttattgacgctgaggcgcgaaagcgtggggagcaaacaggattagataccctggtagtccacgccgtaaacgatgagtgctaggtgttaggggtttcgatgcccttagtgccgaagctaacgcattaagcactccgcctggggagtacggccgcaaggctgaaactcaaaagaattgacgggggcccgcacaagcggtggagcatgtggtttaattcgacgcaacgcgaagaaccttaccaggtcttgacatcttttgctacttctggagacagaaggttccccttcgggggacaaaatgacaggtggtgcatggttgtcgtcagctcgtgtcgtgagatgttgggttaagtcccgcaacgagcgcaacccttaatcttagttgccagcatttggttgggcactctaaggtgactgccggtgacaaaccggaggaaggtggggacgacgtcaaatcatcatgccccttatgacctgggctacacacgtgctacaatggatggtacagagggatgcgaaaccgcgaggtggagccaatctcgcaaagccattctcagttcggattgcaggctgcaactcgcctgcatgaagccggaatcgctagtaatcgtggatcagcatgccacggtgaatacgttcccgggccttgtacacaccgcccgtcacaccacgagagtttgcaacacccgaagtcggtgaggtaaccctttgggagccagccgccgaaggtggggcagatgattggggtgaagtcgtaacaaggtatccctaccggaaggtggggatggatcacctcctttcta

SEQ ID NO: 8410 - DNA, 1533 bp, Sinobacteraceae bacterium
  ref <308>: DATABASE ACCESSION NUMBER: NCBI ACCESSION: NZ_RJVO01000001.1
  ref <309>: DATABASE ENTRY DATE: 2019-04-01
  ref <313>: RELEVANT RESIDUES IN SEQ ID NO: (1)..(1533)
taattggagagtttgatcctggctcagattgaacgctggcggaatgcctaacacatgcaagtcgagcggggtagcaatatccagcggcggacgggtgaggaatacataggaatctgcctttaggtgggggatagcttggggaaactcaaggtaataccgcatgatctcgcaagagcaaagtgggggaccgcaaggcctcacgcctttagaggagcctatgtctgattagctagttggtgaggtaatggctcaccaaggcaacgatcagtaactggtctgagaggacgatcagtcacaccggaactgagacacggtccggactcctacgggaggcagcagtggggaatattggacaatgggcgaaagcctgatccagcaattccgcgtgtgtgaagaaggccttcgggttgtaaagcactttaggttgggaagaaaaaacttctcctaatacgagaagcgttgacggtaccaacagaataagcaccggctaactctgtgccagcagccgcggtaatacagagggtgcaagcgttaatcggatttactgggcgtaaagcgtgcgtaggtggtttcgtaagtcggatgtgaaagccccgggctcaacctgggaactgcattcgatactgcgagactcgagtttggtagagggtggcggaattcccggtgtagcggtgaaatgcgtagatatcgggaggaacatcaatggcgaaggcagccacctgggcctgaactgacactgaggcacgaaagcgtgggtagcaaacaggattagataccctggtagtccacgccgtaaacgatgagaacttgacgttggttcgttttacgaatcggtgtcgtagctaacgcgataagttctccgcctggggagtacggccgcaaggttgaaactcaaaggaattgacgggggcccgcacaagcggtggagtatgtggtttaattcgatgcaacgcgaagaaccttacctggtcttgacatccagagaatcctgcagagatgcgggagtgccttcgggagctctgagacaggtgctgcatggctgtcgtcagctcgtgtcgtgagatgttgggttaagtcccgcaacgagcgcaacccttgcccttagttgccaccatttagttgagcactctaaggggaccgccggtgacaaaccggaggaaggtggggatgacgtcaagtcatcatggcccttatgaccagggctacacacgtactacaatgggcagtacagagggtcgccaacccgcgagggggagctaatcccagaaagctgttcgtagtccggattggagtctgcaactcgactccatgaagtcggaatcgctagtaatcgccgatcagcatttgcggcggtgaatacgttcccgggccttgtacacaccgcccgtcacaccatggaagttggctgcaccagaagtagttagtctaaccgcaaggggggcgattaccacggtgtggtcaatgactggggtgaagtcgtaacaaggtagccgtaggggaacctgcggctggatcacctcctttcaagaatgc

SEQ ID NO: 8411 - DNA, 1276 bp, Sinobacterium caligoides
  ref <308>: DATABASE ACCESSION NUMBER: NCBI ACCESSION: NZ_RKHR01000002.1
  ref <309>: DATABASE ENTRY DATE: 2019-04-01
  ref <313>: RELEVANT RESIDUES IN SEQ ID NO: (1)..(1276)
caccaaggcgacgatccgtagctggtctgagaggatgatcagccacactgggactgagacacggcccagactcctacgggaggcagcagtggggaatattgcacaatgggcgaaagcctgatgcagccatgccgcgtgtgtgaagaaggccttagggttgtaaagcactttcagcgaggaggaaaggttgttcgttaatatcgaacaactgtgacgttactcgcagaagaaggaccggctaactccgtgccagcagccgcggtaatacggagggtccgagcgttaatcggaattactgggcgtaaagcgcgcgtaggcggcttgttaagtcagatgtgaaagccctgggctcaacctgggaactgcatttgatactggcaagctagagtatgggagaggacagtggaatttctagtgtagcggtgaaatgcgtagatattagaaggaacaccagtggcgaaggcgactgtctggcccaatactgacgctgaggtgcgaaagcgtggggagcaaacaggattagataccctggtagtccacgccgtaaacgatgtctactagtcgttgggacccttgtggtcttagtgacgcagctaacgcaataagtagaccgcctggggagtacggccgcaaggttaaaactcaaatgaattgacgggggcccgcacaagcggtggagcatgtggtttaattcgatgcaacgcgaagaaccttaccaggtcttgacatccagagaattcgctagagatagcttagtgccttcgggaactctgtgacaggtgctgcatggctgtcgtcagctcgtgtcgtgagatgttgggttaagtcccgtaacgagcgcaacccttgtccttatttgccagcacgtaatggtgggaactctaaggagactgccggtgacaaaccggaggaaggtggggacgacgtcaagtcatcatggcccttacgacctgggctacacacgtgctacaatgggcagtacagagggccgcaaactcgcgagagtaagccaatcccaaaaaactgttcgtagtccggattggagtctgcaactcgactccatgaagtcggaatcgctagtaatcgtgaatcagaatgtcacggtgaatacgttcccgggccttgtacacaccgcccgtcacaccatgggagtaggttgcaccagaagtagctagtctaaccttcggggggacggttaccacggtgtgatttatgactggggtgaagtcgtaacaaggtagccctaggggaacctggggctggatcacctccttaa

SEQ ID NO: 8412 - DNA, 1525 bp, Sinomicrobium pectinilyticum
  ref <308>: DATABASE ACCESSION NUMBER: NCBI ACCESSION: NZ_RJTM01000213.1
  ref <309>: DATABASE ENTRY DATE: 2019-04-01
  ref <313>: RELEVANT RESIDUES IN SEQ ID NO: (1)..(1525)
aacgatgaagagtttgatcctggctcaggatgaacgctagcggcaggcctaacacatgcaagtcgaggggtataaggagcttgctccttagagaccggcgcacgggtgcgtaacgcgtatgcaatctgccttatgcaggggaatagcccgaagaaatttggattaatgccccatggtatgtagaataggcatctattttatattaaaggtttttccggcataagatgagcatgcgtcccattagctagttggtgtggtaacggcataccaaggcaacgatgggtaggggtcctgagagggagatcccccacactggtactgagacacggaccagactcctacgggaggcagcagtgaggaatattggacaatggtcgggagactgatccagccatgccgcgtgcaggaagactgccctatgggttgtaaactgcttttctacgagaagaataaggggtacgtgtaccctgatgacggtatcgtaggaataagcatcggctaactccgtgccagcagccgcggtaatacggaggatgcaagcgttatccggaatcattgggtttaaagggtccgtaggcgggctgttaagtcaggggtgaaagtttgccgcttaacggtaaaattgcctttgatactggcggtcttgaatgtgtgtgaagtgattagaatatgtagtgtagcggtgaaatgcatagatattacatagaataccgattgcgaaggcaggtcactaacacattattgacgctgatggacgaaagcgtgggtagcgaacaggattagataccctggtagtccacgccgtaaacgatggatactagctgttggggtgtaagtctcagtggctaagcgaaagtgataagtatcccacctggggagtacgttcgcaagaatgaaactcaaaggaattgacgggggcccgcacaagcggtggagcatgtggtttaattcgatgatacgcgaggaaccttaccaaggcttaaatgtggattgacgtagttggaaacagctatttcttcggacaattcacaaggtgctgcatggttgtcgtcagctcgtgccgtgaggtgtcaggttaagtcctataacgagcgcaacccctgtggttagttaccagcgagtaatgtcggggactctaaccagactgccggtgcaaaccgtgaggaaggtggggatgacgtcaaatcatcacggcccttacgtcttgggctacacacgtgctacaatggtcggtacagagagcagccacttagcgataaggagcgaatctataaaaccgatcacagttcggatcggagtctgcaactcgactccgtgaagctggaatcgctagtaatcggatatcagccatgatccggtgaatacgttcccgggccttgtacacaccgcccgtcaagccatggaagccgggggtacctgaagtcggtgaccgcaaggagctgcctagggtaaaactggtaactggggctaagtcgtaacaaggtagccgtaccggaaggtgcggctggaacacctcctttctaga

SEQ ID NO: 8413 - DNA, 1491 bp, Sinorhizobium americanum
  ref <308>: DATABASE ACCESSION NUMBER: NCBI ACCESSION: NZ_LODU01000042.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatgagcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactgggtgtctagagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcgggtacgagagatcgtatccttcagttcggctggaccggagacaggtgctgcatggctgtcgtcagctcgtgtcgtgagatgttgggttaagtcccgcaacgagcgcaaccctcgcccttagttgccagcatttggttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 8414 - DNA, 1492 bp, Sinorhizobium arboris
  ref <308>: DATABASE ACCESSION NUMBER: NCBI ACCESSION: NZ_ATYB01000014.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtataagcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggattgttaagtgaggggtgaaatcccagggctcaaccctggaactgcctttcatactggcaatctagagtccagaagaggtgagtggaattccgagtgtagaggtgaaattcgtagatattcggaggaacaccagtggcgaaggcggctcactggtctggtactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggatacgagagatcgtatccttcagttcggctggaccggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 8415 - DNA, 1491 bp, Sinorhizobium fredii
  ref <308>: DATABASE ACCESSION NUMBER: NCBI ACCESSION: NZ_CP029451.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatgagcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactgggtgtctagagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggatacgagagatcgtatccttcagttcggctggatcggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 8416 - DNA, 1352 bp, Sinorhizobium medicae
  ref <308>: DATABASE ACCESSION NUMBER: NCBI ACCESSION: NZ_RPJI01000008.1
  ref <309>: DATABASE ENTRY DATE: 2019-04-01
  ref <313>: RELEVANT RESIDUES IN SEQ ID NO: (1)..(1352)
tcaacttgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtataagcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggattgttaagtgaggggtgaaatcccagggctcaaccctggaactgcctttcatactggcaatctagagtccagaagaggtgagtggaattccgagtgtagaggtgaaattcgtagatattcggaggaacaccagtggcgaaggcggctcactggtctggtactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggataggagagatcctatccttcagttcggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtca

SEQ ID NO: 8417 - DNA, 1492 bp, Sinorhizobium meliloti
  ref <308>: DATABASE ACCESSION NUMBER: NCBI ACCESSION: NZ_FNYP01000121.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatgagcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggattgttaagtgaggggtgaaatcccagggctcaaccctggaactgcctttcatactggcaatctagagtccagaagaggtgagtggaattccgagtgtagaggtgaaattcgtagatattcggaggaacaccagtggcgaaggcggctcactggtctggaactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggatacgagagatcgtatccttcagttcggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 8418 - DNA, 1492 bp, Sinorhizobium saheli
  ref <308>: DATABASE ACCESSION NUMBER: NCBI ACCESSION: NZ_LNQB01000024.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgagcgcgtggcaatacgagcggcagacgggtgagtaacgcgtgggaatctacccttttctacggaataacgcagggaaacttgtgctaataccgtatgagcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactgggtgtctagagtccggaagaggtgagtggaattccgagtgtagaggtgaaattcgtagatattcggaggaacaccagtggcgaaggcggctcactggtccggaactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggatacgagagatcgtattcttcagttcggctggaccggagacaggtgctgcatggctgtcgtcagctcgtgtcgtgagatgttgggttaagtcccgcaacgagcgcaaccctcgcccttagttgccagcatttggttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 8419 - DNA, 1492 bp, Sinorhizobium sp. A49
  ref <308>: DATABASE ACCESSION NUMBER: NCBI ACCESSION: NZ_MUNW01000023.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgagcgccccgcaaggggagcggcagacgggtgagtaacgcgtgggaatctacccttttctacggaataacgcatggaaacgtgtgctaataccgtatgagcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccagagctcaactctggaactgcctttgatactgggtgtctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggattacagagatgtattccttcagttcggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 8420 - DNA, 1283 bp, Sinorhizobium sp. GL28
  ref <308>: DATABASE ACCESSION NUMBER: NCBI ACCESSION: NZ_AUSZ01000037.1
  ref <309>: DATABASE ENTRY DATE: 2019-04-01
  ref <313>: RELEVANT RESIDUES IN SEQ ID NO: (1)..(1283)
agcttgttggcggggtaacggcccaccaaggcaacgatcagtaggggttctgagaggaaggtcccccacattggaactgagacacggtccaaactcctacgggaggcagcagtgaggaatattggtcaatgggcggaagcctgaaccagccaagtagcgtgagggacgactgccctatgggttgtaaacctcttttataagggaataaaatacgggacgtgtcctgttttgcatgtaccttatgaataaggaccggctaattccgtgccagcagccgcggtaatacggaaggtccaggcgttatccggatttattgggtttaaagggagcgcaggcggtcttataagcgtgacgtgaaatgcagcggctcaaccgtatgatgtgcgtcgcgaactgtaggacttgagtgtattcgatgtcagcggaatttgtggtgtagcggtgaaatgcttagatatcacgaagaactccgattgcgaaggcagctgacaaggctacaactgacgctaaagctcgaaagtgcgggtatcgaacaggattagataccctggtagtccgcacggtaaacgatggatgcccggtgtttgcgatatacagtgagcgcccaagcgaaagcgttaagcatcccacctggggagtacgccggcaacggtgaaactcaaaggaattgacgggggcccgcacaagcggaggaacatgtggtttaattcgatgatacgcgaggaaccttacccgggcttgaactgtaggcgaacgatccagagatggtgaggcccttcggggcgcctatggaggtgctgcatggttgtcgtcagctcgtgccgtgaggtgtcggcttaagtgccataacgagcgcaacccctctcttcagttgccatcaggttaggctgggcactctggagacactgccaccgtaaggtgtgaggaaggtggggatgacgtcaaatcagcacggcccttacgtccggggctacacacgtgttacaatgggtggtacagagagttgagtgtacgcaagtgcattctaatcaagaaagccatcctcagttcggactggggtctgcaacccgaccccacgaagctggattcgctagtaatcgcgcatcagccatggcgcggtgaatacgttcccgggccttgtacacaccgcccgtcaagccatgaaagctgggggcacctgaagtccgtgaccgcaagggtcggcctagggtgaaaccggtgattggggctaagtcgtaacaaggtagccgtaccggaaggtgcggctggaacacctcctttct

SEQ ID NO: 8421 - DNA, 1492 bp, Sinorhizobium sp. GW3; identical to SEQ ID NO: 3439
  ref <308>: DATABASE ACCESSION NUMBER: NCBI ACCESSION: NZ_AUSY01000090.1
  ref <309>: DATABASE ENTRY DATE: 2019-04-01
  ref <313>: RELEVANT RESIDUES IN SEQ ID NO: (1)..(1492)

SEQ ID NO: 8422 - DNA, 1491 bp, Sinorhizobium sp. M4 45; identical to SEQ ID NO: 3435
  ref <308>: DATABASE ACCESSION NUMBER: NCBI ACCESSION: NZ_NWVE01000021.1
  ref <309>: DATABASE ENTRY DATE: 2019-04-01
  ref <313>: RELEVANT RESIDUES IN SEQ ID NO: (1)..(1491)

SEQ ID NO: 8423 - DNA, 1500 bp, Sinorhizobium sp. PC2; identical to SEQ ID NO: 3423
  ref <308>: DATABASE ACCESSION NUMBER: NCBI ACCESSION: NZ_LATE01000001.1
  ref <309>: DATABASE ENTRY DATE: 2019-04-01
  ref <313>: RELEVANT RESIDUES IN SEQ ID NO: (1)..(1500)

SEQ ID NO: 8424 - DNA, 1494 bp, Sinorhizobium sp. RAC02
  ref <308>: DATABASE ACCESSION NUMBER: NCBI ACCESSION: NZ_CP016450.1
  ref <309>: DATABASE ENTRY DATE: 2019-04-01
  ref <313>: RELEVANT RESIDUES IN SEQ ID NO: (1)..(1494)
tcaacatgagagtttgatcctggctcagaacgaacgctggcggcaggcttaacacatgcaagtcgaacgccccgcaaggggagtggcagacgggtgagtaacgcgtgggaatctacccatctctacggaataactcagggaaacttgtgctaataccgtatacgcccttcgggggaaagatttatcggagatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggatcgatcagtcaggggtgaaatcccagagctcaactctggaactgcctttgatactgtcgatctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcggcatgcatgcatgtcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggacagtggagacattgtccttcagttaggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgcgccaacccgcaagggaagcaggcgaccacggtagggtcagcgactggggtgaagtcgtaacaaggtagccgtaggggaacctgcggctggatcacctcctttctaagg

SEQ ID NO: 8425 - DNA, 1190 bp, Sinorhizobium sp. Sb3
  ref <308>: DATABASE ACCESSION NUMBER: NCBI ACCESSION: NZ_AUTA01000035.1
  ref <309>: DATABASE ENTRY DATE: 2019-04-01
  ref <313>: RELEVANT RESIDUES IN SEQ ID NO: (1)..(1190)
tcaacttgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtataagcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccagagctcaactctggaactgcctttgatactgggtgtctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggattacggagacgttttccttcagttcggctggatcggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtgg

SEQ ID NO: 8426 - DNA, 1511 bp, Siphonobacter curvatus
  ref <308>: DATABASE ACCESSION NUMBER: NCBI ACCESSION: NZ_PTRA01000008.1
  ref <309>: DATABASE ENTRY DATE: 2019-04-01
  ref <313>: RELEVANT RESIDUES IN SEQ ID NO: (1)..(1511)
tttacaatggagagtttgatcctggctcaggatgaacgctagcggcaggcctaatacatgcaagtcaaacgggtagcaataccagtggcgtacgggtgcgtaacgcgtatgcaacctacctttaactgggggacaacagcgggaaactgctgctaataccccgtaacgcaggggcacggcatcgtgatactgctaaagaagcaattcggttagagatgggcatgcgttcgattagctagttggtgcaggtaacggctcaccaaggcgacgatcgataggggctctgagaggagaatcccccacactggcactgagatacgggccagactcctacgggaggcagcagtagggaatattgggcaatggaggaaactctgacccagccatgccgcgtgcaggaagaaggccctctgggttgtaaactgcttttgatagggaagaaagaggtcatgcgtgaccagttgacggtacctatcgaataagcaccggctaactacgtgccagcagccgcggtaatacgtagggtgcaagcgttgtccggatttattgggtttaaagggtgcgtaggcggtttattaagtcagtggtgaaagacgatcgctcaacgattgcagtgccattgatactggtaaacttgagtagtgcagaggtagctggaattgatcgtgtagcggtgaaatgcatagatatgatcaagaacgccaattgcgaaggcaggttactggacactcactgacgctgaggcacgaaagtgtggggatcaaacaggattagataccctggtagtccacactgtaaacgatgataactcgctgttggcacttggtgtcagcggcttagggaaaccgttaagttatccacctggggagtacgccggcaacggtgaaactcaaaggaattgacgggggtccgcacaagcggtggagcatgtggtttaattcgatgatacgcgaggaaccttacctgggctagaatgtgagtgaagctatcagaaatggtagcgtccgcaaggacacgaaacaaggtgctgcatggctgtcgtcagctcgtgccgtgaggtgttgggttaagtcccgcaacgagcgcaacccctgcgagtagttaccagcgagtcaagtcggggactctactcggactgcctgtgcaaacagagaggaaggaggggacgacgtcaagtcatcatggcccttacgcccagggccacacacgtgctacaatggtcggtacaaagggtcgccacttggtaacaaggagccaatctctaaagccgatcacagttcggattgaggtctgcaactcgacctcatgaagctggaatcgctagtaatcgggtatcagccatgatccggtgaatacgttcccggaccttgtacacaccgcccgtcaagccatgggagtttggtgtacctgaagtcggccggttcaaggtcgattagggtaaaacaggcgactggggctaagtcgtaacaaggtagccgtaccggaaggtgcggctggaacacctcctttct

SEQ ID NO: 8427 - DNA, 1511 bp, Siphonobacter sp. BAB-5405
  ref <308>: DATABASE ACCESSION NUMBER: NCBI ACCESSION: NZ_NJAG01000213.1
  ref <309>: DATABASE ENTRY DATE: 2019-04-01
  ref <313>: RELEVANT RESIDUES IN SEQ ID NO: (1)..(1511)
tttacaatggagagtttgatcctggctcaggatgaacgctagcggcaggcctaatacatgcaagtcaaacgggtagcaataccagtggcgtacgggtgcgtaacgcgtatgcaacctacctttaactgggggacaacagcgggaaactgctgctaataccccgtaacgcaggggcacggcatcgtgatactgctaaagaagtgattcggttagagatgggcatgcgttcgattagctagttggtgcaggtaacggctcaccaaggcgacgatcgataggggctctgagaggagaatcccccacactggcactgagatacgggccagactcctacgggaggcagcagtagggaatattgggcaatggaggaaactctgacccagccatgccgcgtgcaggaagaaggccctctgggttgtaaactgcttttgatagggaagaaagaggtcatgcgtgaccagttgacggtacctatcgaataagcaccggctaactacgtgccagcagccgcggtaatacgtagggtgcaagcgttgtccggatttattgggtttaaagggtgcgtaggcggtttattaagtcagtggtgaaagacgatcgctcaacgattgcagtgccattgatactggtaaacttgagtagtgcagaggtagctggaattgatcgtgtagcggtgaaatgcatagatatgatcaagaacgccaattgcgaaggcaggttactggacactcactgacgctgaggcacgaaagtgtggggatcaaacaggattagataccctggtagtccacactgtaaacgatgataactcgctgttggcccctggggtcagcggcttagggaaaccgttaagttatccacctggggagtacgccggcaacggtgaaactcaaaggaattgacgggggtccgcacaagcggtggagcatgtggtttaattcgatgatacgcgaggaaccttacctgggctagaatgtgagtgaagctatcagaaatggtagcgtccgcaaggacacgaaacaaggtgctgcatggctgtcgtcagctcgtgccgtgaggtgttgggttaagtcccgcaacgagcgcaacccctgcgagtagttaccagcgagtcaagtcggggactctactcggactgcctgtgcaaacagagaggaaggaggggacgacgtcaagtcatcatggcccttacgcccagggccacacacgtgctacaatggtcggtacaaagggtcgccacttggtaacaaggagccaatctctaaagccgatcacagttcggattgaggtctgcaactcgacctcatgaagctggaatcgctagtaatcgggtatcagccatgatccggtgaatacgttcccggaccttgtacacaccgcccgtcaagccatgggagtttggtgtacctgaagtcggccggttcaaggtcgattagggtaaaacaggcgactggggctaagtcgtaacaaggtagccgtaccggaaggtgcggctggaacacctcctttct

SEQ ID NO: 8428 - DNA, 461 bp, Skermanella aerolata
  ref <308>: DATABASE ACCESSION NUMBER: NCBI ACCESSION: NZ_AVFK01000211.1
  ref <309>: DATABASE ENTRY DATE: 2019-04-01
  ref <313>: RELEVANT RESIDUES IN SEQ ID NO: (1)..(461)
taattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatggg

SEQ ID NO: 8429 - DNA, 987 bp, Skermanella stibiiresistens
  ref <308>: DATABASE ACCESSION NUMBER: NCBI ACCESSION: NZ_AVFL01000102.1
  ref <309>: DATABASE ENTRY DATE: 2019-04-01
  ref <313>: RELEVANT RESIDUES IN SEQ ID NO: (1)..(987)
ctgggcgtaaagcgcacgcaggcggtttgttaagtcagatgtgaaatccccgggctcaacctgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 8430 - DNA, 1274 bp, Slackia equolifaciens
  ref <308>: DATABASE ACCESSION NUMBER: NCBI ACCESSION: NZ_QIBX01000038.1
  ref <309>: DATABASE ENTRY DATE: 2019-04-01
  ref <313>: RELEVANT RESIDUES IN SEQ ID NO: (1)..(1274)
gacggcggggtgacggcccaccgtgcctacaacgggtagccgggctgagaggccgatcggccacattgggactgagacacggcccagactcctacgggaggcagcagtggggaattttgcgcaatgggggcaaccctgacgcagcaacgccgcgtgcgggacgaaggccttcgggtcgtaaaccgctttcagcagggaagaaaccatgacggtacctgcagaagaagccccggctaactacgtgccagcagccgcggtaatacgtagggggcgagcgttatccggattcattgggcgtaaagcgcgcgcaggcggcctctcaagcggcaccgtcgaagccgggggctcaacccccggaagcgggccgaactggggggctcgaggcaggcagaggaaggcggaattcccggtgtagcggtggaatgcgcagatatcgggaagaacaccgacggcgaaggcagccttctgggcctgtcctgacgctcaggcgcgaaagccgggggagcgaacaggattagataccctggtagtcccggccgtaaacgatgggcgctaggtgtgggggcgacatgcctccgtgccgaagccaacgcattaagcgccccgcctggggagtacggccgcaaggctaaaactcaaaggaattgacgggggcccgcacaagcggcggagcatgtggcttaattcgaagcaacgcgaagaaccttaccagggcttgacatcaccgtgagccggcggagacgccggggccgagaggagcggtgacaggtggtgcatggctgtcgtcagctcgtgtcgtgagatgttgggttaagtcccgcaacgagcgcaacccctgccgtatgttgccagcatgtaacgatggggactcatacgggaccgccggcgtcaagccggaggaaggcggggacgacgtcaagtcatcatgccccttacgccctgggctgcacacgtgctacaatggccggtacagagggaagccaccccgcgagggggagccgatcccgaaaagccggccccagttcggatcggaggctgcaacccgcctccgtgaagccggagtcgctagtaatcgcggatcagcatgccgcggtgaatacgttcccgggccttgtacacaccgcccgtcacaccacccgagtcgtctgcacccgaagccgccggccgaacccgagaggggcggaggcgtcgaaggtgtggagggtgaggggggtgaagtcgtaacaaggtagccgtaccggaaggtgcggctggatcacctcctttctagggag

SEQ ID NO: 8431 - DNA, 1520 bp, Slackia exigua
  ref <308>: DATABASE ACCESSION NUMBER: NCBI ACCESSION: NZ_UGGM01000001.1
  ref <309>: DATABASE ENTRY DATE: 2019-04-01
  ref <313>: RELEVANT RESIDUES IN SEQ ID NO: (1)..(1520)
gaacggagagtttgatcctggctcaggatgaacgctggcggcgcgcctaacacatgcaagtcgaacggttaaggccccctttagggggcgcatagagtggcgaacgggtgagtaacacgtgaccaacccgccccccccaccgggacaacctcgggaaaccgaggctaataccggatacgccggggcccccgcatgggggccccgggaaagccttggcgggaggggacggggtcgcggcccatcaggtagacggcggggcgaaggcccgccgtgccgacgacgggtagccgggctgagaggccgatcggccacattgggactgagacacggcccagactcctacgggaggcagcagtggggaatattgcgcaatggggggaaccctgacgcagcgacgccgcgtgcgggaaggaggccttcgggtcgtaaaccgctttcagcagggaagaagcctgacggtacctgcagaagaagccccggctaactacgtgccagcagccgcggtaatacgtagggggcgagcgttatccggattcattgggcgtaaagcgcgcgcaggcggcccgccaagcggcctcgtcgaagccgggggctcaacccccggaagcgacccgaactggcgggctcgagtggggcaggggaggatggaattcccggtgtagcggtgaaatgcgcagatatcgggaggaacaccgacggcgaaggcagccctctgggccttcactgacgctgaggcgcgaaagctgggggagcgaacaggattagataccctggtagtcccagccgtaaacgatgggcgctaggtgcggggggacacgaccctccgtgccgcagccaacgcattaagcgccccgcctggggagtacggccgcaaggctaaaactcaaaggaattgacgggggcccgcacaagcagcggagcatgtggcttaattcgaagcaacgcgaagaaccttaccagggcttgacatgcgggtgaagcggcggagacgccgtggccggaaggagcccgcgcaggtggtgcatggctgtcgtcagctcgtgtcgtgagatgttgggttaagtcccgcaacgagcgcaacccccgccgcatgttgccagcattcagttgggcactcatgcgggaccgccggcgccaagccggaggaaggcggggacgacgtcaagtcatcatgccccccatgccctgggccgcacacgtgctacaatggccggcacagcgggcagcggacccgcgagggcgagcgaatcccttaaagccggccccagttcggatcggaggctgcaacccgcctccgtgaagccggagttgctagtaatcgcggatcagcacgccgcggtgaatgcgttcccgggccttgtacacaccgcccgtcacaccacccgagtcgtctgcacccgaagccgccggcccaacccgcaagggggggaggcgtcgaaggtgtggagggtgaggggggtgaagtcgtaacaaggtagccgtaccggaaggtgcggctggatcacctcctttctagggag

SEQ ID NO: 8432 - DNA, 1522 bp, Slackia faecicanis
  ref <308>: DATABASE ACCESSION NUMBER: NCBI ACCESSION: NZ_QICB01000013.1
  ref <309>: DATABASE ENTRY DATE: 2019-04-01
  ref <313>: RELEVANT RESIDUES IN SEQ ID NO: (1)..(1522)
ttcgaacggagagtttgatcctggctcaggatgaacgctggcggcgtgcctaacacatgcaagtcgaacggttaaggcgccttcgggcgcgaatagagtggcgaacgggtgagtaacgcgtggccaacctgccccctcctccgggacaacctcgggaaaccgaggctaataccggatgctccgggccccccgcatggggggcccgggaaagcccaggcgggaggggatggggccgcgtcccatcaggtagtaggcggggtgacggcccacctagctgacgacgggtagccggactgagaggtcgatcggccacattgggactgagacacggcccagactcctacgggaggcagcagtggggaattttgcgcaatgggggaaaccctgacgcagcaacgccgcgtgcgggacgaaggccttcgggtcgtaaaccgctttcggcagggaagaattttgacggtacctgcagaagaagccccggctaactacgtgccagcagccgcggtaatacgtagggggcgagcgttatccggattcattgggcgtaaagcgcgcgtaggcgtctcctcaagcggcaccgtcgaagccgggggctcaacccccggaagcgggccgaactggggggatcgagtgcggtaggggcaggcggaattcccggtgtagcggtgaaatgcgcagatatcgggaagaacaccgacggcgaaggcagcctgctgggccggcactgacgctgaggcgcgaaagctgggggagcgaacaggattagataccctggtagtcccagccgtaaacgatgggcgctaggtgtgggggagccattcctccgtgccgcagccaacgcattaagcgccccgcctggggagtacggccgcaaggctaaaactcaaaggaattgacgggggcccgcacaagcagcggagcatgtggcttaattcgaagcaacgcgaagaaccttaccagggcttgacatcaccgtgagccggcggagacgccggggccgaaaggagcggtgacaggtggtgcatggctgtcgtcagctcgtgtcgtgagatgttgggttaagtcccgcaacgagcgcaacccccgccgtatgttgccatcgggtaatgccgggcactcgtacgggaccgccggagccaatccggaggaaggcggggacgacgtcaagtcatcatgcccctcatgccctgggctgcacacgtgctacaatggccggtacaacgggccgccacgccgcgaggcggagcgaatccctcaaagccggccccagttcggatcgcaggctgcaacccgcctgcgtgaagccggagttgctagtaatcgcggatcagcatgccgcggtgaatacgttcccgggccttgtacacaccgcccgtcacaccacccgagtcgtctgcacccgaagccgccggccgaacccgaaaggggcggaggcgtcgaaggtgtggagggtgaggggggtgaagtcgtaacaaggtagccgtaccggaaggtgcggctggatcacctcctttctagggag

SEQ ID NO: 8433 - DNA, 1525 bp, Slackia heliotrinireducens
  ref <308>: DATABASE ACCESSION NUMBER: NCBI ACCESSION: NZ_LR134379.1
  ref <309>: DATABASE ENTRY DATE: 2019-04-01
  ref <313>: RELEVANT RESIDUES IN SEQ ID NO: (1)..(1525)
cattcaaacggagagtttgatcctggctcaggatgaacgctggcggcgcgcctaacacatgcaagtcgaacgattaaaccgccctcgggcggacatacagtggcgaacgggtgagtaacacgtgaccaacccgccccctcctccgggacaacctcgggaaaccgtggctaataccggatactccggcagcagcgcatgctgcggccgggaaagcccagacgggaggggatggggtcgcggcccatcaggtagacggcggggcaacggcccgccgtgccgacgacgggtagccgggctgagaggctgatcggccacattgggactgagacacggcccagactcctacgggaggcagcagtggggaatcttgcgcaatggggggaaccctgacgcagcgacgccgcgtgcgggacgaaggccttcgggtcgtaaaccgctttcagcagggaagaaacatgacggtacctgcagaagaagctccggctaactacgtgccagcagccgcggtaatacgtagggagcgagcgttatccggattcattgggcgtaaagcgcgcgcaggcggccggccaagcgggcctcgtcgaagccgtgggctcaacccgcggaagcgacccgaactggccggctcgagtgaggtaggggaggatggaattcccggtgtagcggtggaatgcgcagatatcgggaggaacaccgacggcgaaggcagtcctctgggccttcactgacgctgaggcgcgaaagctgggggagcgaacaggattagataccctggtagtcccagccgtaaacgatgggcgctaggtgtggggggccggaccccccgtgccgcagccaacgcattaagcgccccgcctggggagtacggccgcaaggctaaaactcaaaggaattgacgggggcccgcacaagcagcggagcatgtggcttaattcgaagcaacgcgaagaaccttaccagggcttgacatgcaggtgaagcggcggaaacgccgtggcctgaccggagcctgcacaggtggtgcatggctgtcgtcagctcgtgtcgtgagatgttgggttaagtcccgcaacgagcgcaacccctgccgcatgttgccagcatcaagttggggactcatgcgggaccgccggcgccaagccggaggaaggcggggacgacgtcaagtcatcatgcccctcatgccctgggctgcacacgtgctacaatggccggcacagcgggctgcgacgcagcgatgcggagcgaatccctcaaagccggccccagttcggatcggaggctgcaacccgcctccgtgaagccggagttgctagtaatcgcggatcagcacgccgcggtgaatgcgttcccgggccttgtacacaccgcccgtcacaccacccgagtcgtctgcacccgaagccgccggccgaacccgttaaggggcggaggcgtcgaaggtgtggagggtgaggggggtgaagtcgtaacaaggtagccgtacgggaacgtgcggctggatcacctcctttctagggag

SEQ ID NO: 8434 - DNA, 1006 bp, Slackia isoflavoniconvertens
  ref <308>: DATABASE ACCESSION NUMBER: NCBI ACCESSION: NZ_QIBZ01000036.1
  ref <309>: DATABASE ENTRY DATE: 2019-04-01
  ref <313>: RELEVANT RESIDUES IN SEQ ID NO: (1)..(1006)
cacggagagtttgatcctggctcaggatgaacgctggcggcgcgcctaacacatgcaagtcgaacgagtaagacgccttcgggcgtggatagagtggcgaacgggtgagtaacacgtgaccaacctgccccctcctccgggacaacctcgggaaaccgaggctaataccggatactccgggcaccccgcatgggatgcccgggaaagccctggcgggaggggatggggtcgcggcccatcaggtagacggcggggtaacggcccaccgtgcccgcaacgggtagccgggctgagaggccgatcggccacattgggactgagacacggcccagactcctacgggaggcagcagtggggaattttgcgcaatgggggcaaccctgacgcagcgacgccgcgtgcgggacgaagtcattcgtgacgtaaaccgctttcagcgaggaagaaccatgacggtactcgcagaagaagccccggctaactacgtgccagcagccgcggtaatacgtagggggcgagcgttatccggaatcattgggcgtaaagcgcgcgcaggcgggctttcaagcggcggcgtcgaagccgggggctcaacccccggaagcgccccgaactggaagcctcggatgcggcagggggaggcggaattcccggtgtagcggtgaaatgcgcagatatcgggaagaacaccgacggcgaaggcagcctcctgggccggcatcgacgctgaggcgcgaaagctgggggagcgaacaggattagataccctggtagtcccagccgtaaacgatggacgctaggtgtgggggaggaatctcctccgtgccgaagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatcggtgaagccggagagatccggtggccgagaggagcc

SEQ ID NO: 8435 - DNA, 1530 bp, Sneathia amnii
  ref <308>: DATABASE ACCESSION NUMBER: NCBI ACCESSION: NZ_CP011280.1
  ref <309>: DATABASE ENTRY DATE: 2019-04-01
  ref <313>: RELEVANT RESIDUES IN SEQ ID NO: (1)..(1530)
aaaaagataaagaatgaagagtttgatcctggctcaggataaacgctgacagaatgcttaacacatgcaagtctatgaggaagtttagcttgctaaatggactcatggcggacgggtgagtaacgcgtaaagaacttgccctttagactgggataacagagggaaacttctgataatactggataagttagtatatcgcatgatatgcaaatgaaagctacggcactaaaggagagctttgcgtcctattagctagttggtaaggtaagagcttaccaaggcgatgataggtagccggcctgagagggtggacggccacaaggggactgagatacggcccttactcctacgggaggcagcagtggggaatattggacaatggaggaaactctgatccagcaattctgtgtgtgtgaagaaggttttaggactgtaaaacacttttagtagggaagaaaaaaatgacggtacctacagaagaagcaacggctaaatacgtgccagcagccgcggtaatacgtatgttgcgagcgttatccggaattattgggcttaaagggcatctaggcggtaagacaagttgaaggtgaaaacctgtggctcaaccataggcttgcctacaaaactgttgaactagagtactggaaaggtgggtggaactacacgagtagaggtgaaattcgtagatatgtgtaggaatgccgatgatgaagataactcactggacagaaactgacgctgaagtgcgaaagctaggggagcaaacaggattagataccctggtagtcctagctgtaaacgatgatcactgggtgtggggatgcgaagtctctgtgccgaagcaaaagcgataagtgatccgcctggggagtacgttcgcaagaatgaaactcaaaggaattgacgggggcccgcacaagtggtggagcatgtggtttaattcgacgcaacgcgaggaaccttaccagatcttgacatcctcgggagagtatagaagtatacttgtgccttcgggaaccgagagacaggtggtgcatggctgtcgacagctcgtgttgtgagatgttgggttaagtcccgcaacgagcgaaacccctatcattagttgccatcattaagttggggactctaatgaaactgcctacgaagagtaggaggaaggtggggatgacgtcaagtcatcatgccccttatgatctgggctacacacgtgctacaatgggtagtacaaagagaagctttgtagcgatacatggcgaaacttaaaaagctattcttagttcggattgaagtctgcaactcgacttcatgaagttggaatcactagtaatcgtgaatcagcaatgtcacggtgaatacgttctcgggccttgtacacaccgcccgtcacaccacgagagttgtttgcacctgaaattaccggcctaaccgtaaggagggaggtactgaaggtgtggatagtgattggggtgaagtcgtaacaaggtatccgtaccggaaggtgcggatggatcacctcctttctaagga

SEQ ID NO: 8436 - DNA, 1525 bp, Sneathia sanguinegens
  ref <308>: DATABASE ACCESSION NUMBER: NCBI ACCESSION: NZ_LOQF01000021.1
  ref <309>: DATABASE ENTRY DATE: 2019-04-01
  ref <313>: RELEVANT RESIDUES IN SEQ ID NO: (1)..(1525)
gaacgaagagtttgatcctggctcaggataaacgctgacagaatgcttaacacatgcaagtcgatgatgggagctagcttgctagaagaagtcatggcggacgggtgagtaacgtgtaaagaacttaccatatagactgggataacagagggaaacttctgataatactggataagttagtagtagcattactaagtaatgaaaggtagcaatacgctatatgagagctttgcatcctattagctagttggtggggtaaaagcctaccaaggcgatgataggtagccggcctgagagggtggacggccacaaggggactgagatacggcccttactcctacgggaggcagcagtggggaatattggacaatggaggcaactctgatccagcaattctgtgtgtgtgaagaaggttttaggactgtaaaacacttttagtagggaagaaagaaatgacggtacctacagaagaagcgacggctaaatacgtgccagcagccgcggtaatacgtatgtcgcgagcgttatccggaattattgggcttaaagggcatctaggcggttaaacaagttgaaggtgaaaacctgtggctcaaccataggcttgcctacaaaactgtataactagagtactggaaaggtgggtggaactacacgagtagaggtgaaattcgtagatatgtgtaggaatgccgatgatgaagataactcactggacagcaactgacgctgaagtgcgaaagctaggggagcaaacaggattagataccctggtagtcctagctgtaaacgatgatcactgggtgtggggattcgaagtctctgtgccgaagcaaaagcgataagtgatccgcctggggagtacgttcgcaagaatgaaactcaaaggaattgacggggacccgcacaagtggtggagcatgtggtttaattcgacgcaacgcgaggaaccttaccagatcttgacatcctccgaagagcatagaagtatgcttgtgcctacgggaacggagagacaggtggtgcatggctgtcgacagctcgtgttgtgagatgttgggttaagtcccgcaacgagcgaaacccctatcattagttaccatcattaagttggggactctaatgaaactgcctacgaagagtaggaggaaggtggggatgacgtcaagtcatcatgccccttatgatctgggctacacacgtgctacaatggatagtacaaagagaagctttgtagcgatacatggcaaaactaagaaagctattcttagttcggattgaagtctgcaactcgacttcatgaagttggaatcactagtaatcgtgaatcagcaatgtcacggtgaatacgttctcgggtcttgtacacaccgcccgtcacaccacgagagttgtttgcacctgaaattactggcctaactgcaaagggggaggtactgaaggtgtggatagcgattggggtgaagtcgtaacaaggtatccgtaccggaaggtgcggatggatcacctcctttctaaggagaaa

SEQ ID NO: 8437 - DNA, 1510 bp, Sneathiella glossodoripedis
  ref <308>: DATABASE ACCESSION NUMBER: NCBI ACCESSION: NZ_BAMS01000010.1
  ref <309>: DATABASE ENTRY DATE: 2019-04-01
  ref <313>: RELEVANT RESIDUES IN SEQ ID NO: (1)..(1510)
ttcaatcaaacttgagagtttgatcctggctcagaacgaacgctggcggcaggcctaacacatgcaagtcgaacgagaagcttctttcgggaagtggagagtggcgcacgggtgagtaacgcgtggggatctgccctttggtacgggataacgtttggaaacgaacgctaataccgtatattgtctacggacgaaagatttatcgccaaaggatgaacccgcgtaggattagatagttggtggggtaacggcctaccaagtcgacgatctttagctgttctgagaggaagatcagccacactggaactgagacacggtccagactcctacgggaggcagcagtggggaatattggacaatgggcgcaagcctgatccagccatgccgcgtgagtgaagaaggccttagggttgtaaagctctttcgctagggaagataatgacggtacctagtaaagaagtcccggctaactccgtgccagcagccgcggtaatacggaggggactagcgttgttcggaattactgggcgtaaagagtacgtaggcggcttgtcaagttgggtgtgaaagcccggggctcaaccccggaactgcactcaaaactggcaagctagagatcggaagaggtaagtggaattcccagtgtagaggtgaaattcgtagatattgggaagaacaccagtggcgaaggcggcttactggtccgagactgacgctgaggtacgaaagcgtggggagcaaacaggattagataccctggtagtccacgccgtaaacgatgaatgctagttgttgggaggtttacctttcagtgacgcagctaacgcattaagcattccgcctggggagtacggtcgcaagattaaaactcaaaggaattgacgggggcccgcacaagcggtggagcatgtggtttaattcgaagcaacgcgcagaaccttaccagcccttgacatgggtagtatgattaccagagatggttttcttcagttcggctggctaccacacaggtgctgcatggctgtcgtcagctcgtgtcgtgagatgttgggttaagtcccgcaacgagcgcaaccctcgccattagttgccagcattaagttgggcactttaatggaactgccggtgataagccggaggaaggtggggatgacgtcaagtcctcatggcccttatgggctgggctacacacgtgctacaatggcggtgacagtgggaagcgaaggggtgacctggagcaaatctccaaaagccgtctcagttcggattgttctctgcaactcgagagcatgaagttggaatcgctagtaatcgcggatcagcatgccgcggtgaatacgttcccgggccttgtacacaccgcccgtcacaccatgggagttggttttacccgaagccggtgcgcgaaccttttggacgcagccgaccacggtaaggtcagcgactggggtgaagtcgtaacaaggtagccgtaggggaacctgcggctggatcacctcctttctaagga

SEQ ID NO: 8438 - DNA, 1546 bp, Snodgrassella alvi
  ref <308>: DATABASE ACCESSION NUMBER: NCBI ACCESSION: NZ_QGLS01000014.1
  ref <309>: DATABASE ENTRY DATE: 2019-04-01
  ref <313>: RELEVANT RESIDUES IN SEQ ID NO: (1)..(1546)
attaaacataagagtttgatcctggctcagattgaacgctggcggcatgctttacacatgcaagtcgaacggcagcacggagagcttgctctctggtggcgagtggcgaacgggtgagtaatgcatcggaacgtaccgagtaatgggggataactgtccgaaaggatggctaataccgcatacgccctgagggggaaagcgggggatcgaaagacctcgcgttatttgagcggccgatgttggattagctagttggtggggtaaaggcctaccaaggcgacgatccatagcgggtctgagaggatgatccgccacattgggactgagacacggcccaaactcctacgggaggcagcagtggggaattttggacaatggggggaaccctgatccagccatgccgcgtgtctgaagaaggccttcgggttgtaaaggacttttgttagggaagaaaagccgggtgctaataccacctggtgctgacggtacctaaagaataagcaccggctaactacgtgccagcagccgcggtaatacgtagggtgcgagcgttaatcggaattactgggcgtaaagcgagcgcagacggttaattaagtcagatgtgaaatccccgagctcaacttgggacgtgcatttgaaactggttaactagagtgtgtcagagggaggtagaattccacgtgtagcagtgaaatgcgtagagatgtggaggaataccgatggcgaaggcagcctcctgggataacactgacgttcatgctcgaaagcgtgggtagcaaacaggattagataccctggtagtccacgccctaaacgatgacaattagctgttgggacactagatgttttagtagcgaagctaacgcgtgaaattgtccgcctggggagtacggtcgcaagattaaaactcaaaggaattgacggggacccgcacaagcggtggatgatgtggattaattcgatgcaacgcgaagaaccttacctggtcttgacatgtacggaatctcttagagataggagagtgccttcgggaaccgtaacacaggtgctgcatggctgtcgtcagctcgtgtcgtgagatgttgggttaagtcccgcaacgagcgcaacccttgtcattagttgccatcattaagttgggcactctaatgagactgccggtgacaaaccggaggaaggtggggatgacgtcaagtcctcatggcccttatgaccagggcttcacacgtcatacaatggtcggtacagagggtagcgaagccgcgaggtgaagccaatctcagaaagccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaattgggtagactaaccgtaaggaggtcgcttaacacggtatgcttcatgactggggtgaagtcgtaacaaggtagccgtaggggaacctgcggctggatcacctcctttctag

SEQ ID NO: 8439 - DNA, 1539 bp, Soehngenia sp. W6
  ref <308>: DATABASE ACCESSION NUMBER: NCBI ACCESSION: NZ_CP035130.1
  ref <309>: DATABASE ENTRY DATE: 2019-04-01
  ref <313>: RELEVANT RESIDUES IN SEQ ID NO: (1)..(1539)
attaaatgagagtttgatcctggctcaggacgaacgctggcggcgtgcctaacacatgcaagtcgagcgaagtgactctgagagaaattttcggatggattgaagagtcatcttagcggcggacgggtgagtaacgcgtgagaaacctgcctttcacaaagggatagcctcgggaaactgggattaataccttatgaaactgaattaccgcatggtagatcagtcaaagcgaataagcggtgaaagatggtctcgcgtcctattagctagttggtgaggtaacggctcaccaaggcttcgataggtagccggcctgagagggtgaacggccacactggaactgagacacggtccagactcctacgggaggcagcagtggggaatattgcacaatggaggaaactctgatgcagcgacgccgcgtgaatgatgaaggccttcgggttgtaaagttctgtccttggggaagataatgacggtacccaaggaggaagccccggctaactacgtgccagcagccgcggtaatacgtagggggcgagcgttgtccggaattattgggcgtaaagggttcgcaggcggtctgataagtcagatgtgaaaggcgtaggctcaacctacgtaagcatttgaaactgtcagacttgagttaaggagaggaaagtggaattcctagtgtagcggtgaaatgcgtagatattaggaggaataccagtggcgaaggcgactttctggacttatactgacgctgaggaacgaaagcgtggggagcaaacaggattagataccctggtagtccacgccgtaaacgatgagtgctaggtgttgggggtcaaacctcggtgccgcagctaacgcattaagcactccgcctggggagtacgtacgcaagtatgaaactcaaaggaattgacggggacccgcacaagcagcggagcatgtggtttaattcgaagcaacgcgaagaaccttaccagggcttgacatgccgctgaccggtgcagagatgcatctttatccttcggggtacagcggacacaggtggtgcatggttgtcgtcagctcgtgtcgtgagatgttgggttaagtcccgcaacgagcgcaacccttgtctttagttgccatcattaagttgggcactctaaagagactgccgatgacaaatcggaggaaggtggggatgacgtcaaatcatcatgccctttatgtcctgggctacacacgtgctacaatggtcggtacaacgagaagcaagtcagcgatggcaagcaaatctctaaaagccgatcccagttcggattgcaggctgcaactcgcctgcatgaagtcggagttgctagtaatcgcggatcagaatgccgcggtgaatgcgttcccgggtcttgtacacaccgcccgtcacaccatgggagttgtcaatacccgaagccagtgagctaaccagtaatggaggcagctgtcgaaggtaggggcaatgactggggtgaagtcgtaacaaggtagccgtatcggaaggtgcggctggatcacctcctttct

SEQ ID NO: 8440 - DNA, 1241 bp, Solibacillus isronensis
  ref <308>: DATABASE ACCESSION NUMBER: NCBI ACCESSION: NZ_FVZN01000007.1
  ref <309>: DATABASE ENTRY DATE: 2019-04-01
  ref <313>: RELEVANT RESIDUES IN SEQ ID NO: (1)..(1241)
gctgtcactataagatggacccgcggcgcattagctagttggtgaggtaacggctcaccaaggcaacgatgcgtagccgacctgagagggtgatcggccacactgggactgagacacggcccagactcctacgggaggcagcagtagggaatcttccacaatggacgaaagtctgatggagcaacgccgcgtgagtgaagaaggatttcggttcgtaaaactctgttgcaagggaagaacaagtagcgtagtaactggcgctaccttgacggtaccttgttagaaagccacggctaactacgtgccagcagccgcggtaatacgtaggtggcaagcgttgtccggaattattgggcgtaaagcgcgcgcaggtggttccttaagtctgatgtgaaagcccccggctcaaccggggagggtcattggaaactggggaacttgagtgcagaagaggatagtggaattccaagtgtagcggtgaaatgcgtagagatttggaggaacaccagtggcgaaggcgactgtctggtctgtaactgacactgaggcgcgaaagcgtggggagcaaacaggattagataccctggtagtccacgccgtaaacgatgagtgctaagtgttggggggtttccgcccctcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccggtgaccactatggagacatagtttccccttcgggggcaacggtgacaggtggtgcatggttgtcgtcagctcgtgtcgtgagatgttgggttaagtcccgcaacgagcgcaacccttattcttagttgccatcattcagttgggcactctaaggagactgccggtgataaaccggaggaaggtggggatgacgtcaaatcatcatgccccttatgacctgggctacacacgtgctacaatggacggtacaaacggttgccaacccgcgagggggagctaatccgataaaaccgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttt

SEQ ID NO: 8441 - DNA, 1362 bp, Solibacillus kalamii
  ref <308>: DATABASE ACCESSION NUMBER: NCBI ACCESSION: NZ_NHNT01000018.1
  ref <309>: DATABASE ENTRY DATE: 2019-04-01
  ref <313>: RELEVANT RESIDUES IN SEQ ID NO: (1)..(1362)
atggagagtttgatcctggctcaggacgaacgctggcggcgtgcctaatacatgcaagtcgagcggacgaattttcggtgcttgcaccgaattttcgttagcggcggacgggtgagtaacacgtgggtaacctaccttatagattgggataactccgggaaaccggggctaataccgaataatactttttaacacatgtttgaaagttgaaagacggttttgctgtcactataagatggacccgcggcgcattagctagttggtgaggtaacggctcaccaaggcaacgatgcgtagccgacctgagagggtgatcggccacactgggactgagacacggcccagactcctacgggaggcagcagtagggagtaactggcgctaccttgacggtaccttgttagaaagccacggctaactacgtgccagcagccgcggtaatacgtaggtggcaagcgttgtccggaattattgggcgtaaagcgcgcgcaggtggttccttaagtctgatgtgaaagcccccggctcaaccggggagggtcattggaaactggggaacttgagtgcagaagaggatagtggaattccaagtgtagcggtgaaatgcgtagagatttggaggaacaccagtggcgaaggcgactgtctggtctgtaactgacactgaggcgcgaaagcgtggggagcaaacaggattagataccctggtagtccacgccgtaaacgatgagtgctaagtgttggggggtttccgcccctcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccggtgaccactatggagacatagtttccccttcgggggcaacggtgacaggtggtgcatggttgtcgtcagctcgtgtcgtgagatgttgggttaagtcccgcaacgagcgcaacccttattcttagttgccatcattcagttgggcactctaaggagactgccggtgataaaccggaggaaggtggggatgacgtcaaatcatcatgccccttatgacctgggctacacacgtgctacaatggacggtacaaacggttgccaacccgcgagggggagctaatccgataaaaccgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttt

SEQ ID NO: 8442 - DNA, 1554 bp, Solibacillus silvestris
  ref <308>: DATABASE ACCESSION NUMBER: NCBI ACCESSION: NZ_LZRJ01000047.1
  ref <309>: DATABASE ENTRY DATE: 2019-04-01
  ref <313>: RELEVANT RESIDUES IN SEQ ID NO: (1)..(1554)
tttttcggagagtttgatcctggctcaggacgaacgctggcggcgtgcctaatacatgcaagtcgagcggacagaagggagcttgctcccggatgttagcggcggacgggtgagtaacacgtgggtaacctgccyrtaagactgggataactccgggaaaccggrgctaataccggatagttccttgaaccgcatggttcragrwtgaaagrcggyttcggctgtcacttayrgatggacccgcgkcgcattagctagttggtggggtaayggcycaccaaggcracgatgcgtagccgacctgagagggtgatcggccacactgggactgagacacggcccagactcctacgggwggcwgcagtrgggaatmttscgcaatggrcgaaagyctgacgsagcaacgccgcgtgagtgatgaaggytttcggrtcgtaaagctctgttgttagggaagaacaagtgcgagagtaactgctcgcaccttgacggtacctaaccagaaagccmcggctaactmcgtgccagcagccgcggtaatacgkaggkggcragcgttrtycggawttaytgggcgtaaagggykcgyaggcggtttcktaagtckgatgtgaaagcccccggctcaaccggggagggtcattggaaactgggaracttgagtgcrgaagaggagwgtggaattccmsgtgtagcggtgaaatgcgtagakatskgraggaacaccagtggcgaaggcgrcwctctggkcygwwactgacgctgaggwrcgaaagcgtgggkagcraacaggattagatacccykgtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattyagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttctaa

SEQ ID NO: 8443 - DNA, 1565 bp, Solibacillus sp. R5-41
  ref <308>: DATABASE ACCESSION NUMBER: NCBI ACCESSION: NZ_CP024123.1
  ref <309>: DATABASE ENTRY DATE: 2019-04-01
  ref <313>: RELEVANT RESIDUES IN SEQ ID NO: (1)..(1565)
ttttatggagagtttgatcctggctcaggacgaacgctggcggcgtgcctaatacatgcaagtcgagcggactttcattggatgcttgcatcctttggaagttagcggcggacgggtgagtaacacgtgggtaacctaccctgtagattgggataactccgggaaaccggggctaataccgaataacacttttgagctcatgttcgaaagttaaaagatggtttcggctatcactacaggatgggcccgcggcgcattagctagttggtgaggtaacggctcaccaaggcaacgatgcgtagccgacctgagagggtgatcggccacactgggactgagacacggcccagactcctacgggaggcagcagtagggaatcttccacaatggacgaaagtctgatggagcaacgccgcgtgagtgaagaaggatttcggttcgtaaaactctgttgcaagggaagaacaagtagcgtagtaactggcgctaccttgacggtaccttgttagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactgggaaacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttggggggtttccgcccctcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccattgaccactgtagagatacagttttcccttcggggacaacggtgacaggtggtgcatggttgtcgtcagctcgtgtcgtgagatgttgggttaagtcccgcaacgagcgcaacccttattcttagttgccatcatttagttgggcactctaaggagactgccggtgacaaaccggaggaaggtggggatgacgtcaaatcatcatgccccttatgacctgggctacacacgtgctacaatggacggtacaaacggttgccaacccgcgagggggagctaatccgataaaaccgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaacctttatggagccagccgccgaaggtgggatagatgattggggtgaagtcgtaacaaggtagccgtatcggaaggtgcggctggatcacctcctttctaagga

SEQ ID NO: 8444 - DNA, 927 bp, Solimonas fluminis
  ref <308>: DATABASE ACCESSION NUMBER: NCBI ACCESSION: NZ_PSNW01000034.1
  ref <309>: DATABASE ENTRY DATE: 2019-04-01
  ref <313>: RELEVANT RESIDUES IN SEQ ID NO: (1)..(927)
taattggagagtttgatcctggctcagattgaacgctggcggcatgcctaacacatgcaagtcgagcggggtgtagcaatacatccagcggcggacgggtgaggaatacgtaggaatttgccttagagcgggggatagcccagggaaacttggagtaataccgcatgatgtcgaaagaccaaagcaggggaccgcaaggccttgcactctaagagaagcctacgtctgattagctagttggtgaggtaatggctcaccaaggcgacgatcagtaactggtctgagaggacgatcagtcacactggaactgagacacggtccagactcctacgggaggcagcagtggggaatattggacaatgggcgcaagcctgatccagcaatgccgcgtgtgtgaagaaggccttcgggttgtaaagcactttaagcagggaagaaaaaactcggactaacatttcgagtcttgacggtacctgaagaataagcaccggctaactctgtgccagcagccgcggtaatacagagggtgcgagcgttaatcggatttactgggcgtaaagggtgtgtaggtggtttgacaagtcggttgtgaaatccccgggcttaacctgggaactgcttccgagactgtttgactagagtacggtagagggcggtggaatttccggtgtagcggtgaaatgcgtagatatcggaaggaacaccaatggcgaaggcagccgcctgggcctgtactgacactgaaacacgaaagcgtggggatcaaacaggattagataccctggtagtccacgccgtaaacgatggacacttgacgtcggcatgctctgcgtgtcggtgtcgtagctaacgcgataagtgtcccgcctggggagtacggccgcaaggttgaaactcaaaggaattgacgggggcccgcacaagcgg

SEQ ID NO: 8445 - DNA, 1531 bp, Solimonas sp. K1W22B-7
  ref <308>: DATABASE ACCESSION NUMBER: NCBI ACCESSION: NZ_CP031704.1
  ref <309>: DATABASE ENTRY DATE: 2019-04-01
  ref <313>: RELEVANT RESIDUES IN SEQ ID NO: (1)..(1531)
taattggagagtttgatcctggctcagattgaacgctggcggcatgcctaacacatgcaagtcgaacgaggtgtagcaatacatctagtggcggacgggtgaggaatacgtaggaatttgccttagagcgggggatagcccagggaaacttggagtaataccgcatgatgtcgaaagaccaaagcaggggaccgcaaggccttgcactctgagagaagcctacgtctgattagcttgttggtgaggtaatggctcaccaaggcgacgatcagtaactggtctgagaggacgatcagtcacactggaactgagacacggtccagactcctacgggaggcagcagtggggaatattggacaatgggcgcaagcctgatccagcaatgccgcgtgtgtgaagaaggccttcgggttgtaaagcactttaagcagggaagaaaaaactcagattaatactttgagtcttgacggtacctgaagaataagcaccggctaactctgtgccagcagccgcggtaatacagagggtgcgagcgttaatcggatttactgggcgtaaagggtgtgtaggtggtttgacaagtcggttgtgaaatccctgggctcaacctgggaactgcttccgagactgtttgactagagtacggtagagggcggtggaatttccggtgtagcggtgaaatgcgtagatatcggaaggaacaccaatggcgaaggcagccgcctgggcctgtactgacactgaaacacgaaagcgtggggatcaaacaggattagataccctggtagtccacgccgtaaacgatggatacttgacgtcggcatgctctgcgtgtcggtgtcgtagctaacgcgataagtatcccgcctggggagtacggccgcaaggttgaaactcaaaggaattgacgggggcccgcacaagcggtggagtatgtggtttaattcgatgcaacgcgaagaaccttacctggccttgacatgctaggaatccttcagagatgagggagtgcccgcaagggaacctagacacaggtgctgcatggctgtcgtcagctcgtgtcgtgagatgttgggttaagtcccgcaacgagcgcaacccttgcccttagttgccaccatttagttgagcactctaaggggaccgccggtgacaaaccggaggaaggtggggatgacgtcaagtcatcatggcccttatggccagggctacacacgtactacaatggtgtatacagagggtcgccaactcgcaagagggagctaatcccagaaagtacatcgtagtccggattgaggtctgcaactcgacctcatgaagtcggaatcgctagtaatcgccgatcagcatttgcggcggtgaatacgttcccgggccttgtacacaccgcccgtcacaccatgggagttggctgcaccagaagtaggtagtctaaccgcaagggggacgcctaccacggtgtggtcaatgactggggtgaagtcgtaacaaggtagccgtaggggaacctgcggctggatcacctccttta

SEQ ID NO: 8446 - DNA, 1545 bp, Solirubrobacter pauli
  ref <308>: DATABASE ACCESSION NUMBER: NCBI ACCESSION: NZ_RBIL01000002.1
  ref <309>: DATABASE ENTRY DATE: 2019-04-01
  ref <313>: RELEVANT RESIDUES IN SEQ ID NO: (1)..(1545)
cggagagtttgatcctggctcaggacgaacgctggcggcgtgcttaacacatgcaagtggagcgacgaagcggacttcggtccgtggcagagccgcgaacgggtgagtaacacgtgggtaacccaccccaatgaccgggacaacccgaggaaactcgggctaataccggatgttctgtactttcgtaaggaagtccagcaaagatagcttcggccttcgcattgggacgggcccgcggcccattagcttgttggtgaggtaacggcttaccaaggcgacgatgggtagctggtctgagaggacgatcagccacactgggactgagacacggcccagactcctacgggaggcagcagtggggaatcttgcgcaatgggcgaaagcctgacgcagcaacgccgcgtgggggaagaaggccttcgggttgtaaacccctttcagttgggacgaagcttccagtgttaatagcgctgtggagtgacggtaccttcagaagaagccccggctaactacgtgccagcagccgcggtaatacgtagggggcaagcgttgtccggaatcattgggcgtaaagcgcgtgtaggcggtccggtaagtccgctgtgaaagtcgggggctcaaccctcggatgccggtggatactgtcgggcttgagtacggaagaggcgagtggaattcctggtgtagcggtgaaatgcgcagatatcaggaggaacaccaattgcgaaggcagctcgctgggacgttactgacgctgagacgcgaaagcgtggggagcaaacaggattagataccctggtagtccacgctgtaaacgatgggcactaggtgtggggggtgtcgactccctccgtgccgaagctaacgcattaagtgccccgcctggggagtacggccgcaaggctaaaactcaaaggaattgacgggggcccgcacaagcagcggagcatgtggtttaattcgacgcaacgcgaagaaccttacctgggcttgacatgttcgtgacctccctggaaacagggcttcccttcggggcacgatcacaggtggtgcatggctgtcgtcagctcgtgtcgtgagatgttgggttaagtcccgcaacgagcgcaacccccgtcgcatgttgccagcatttagttggggactcatgcgagactgccggtgacaaaccggaggaaggtggggatgacgtcaagtcatcatgccccttatgtccagggctacacacgtgctacattggcgcgtacagagggctgcgataccgtgaggtggagcgaatcccttaaagcgcgtctcggttcggattgtaggctgaaacccgcctacatgaaggcggagttgctagtaatcgcggatcagcattgccgcggtgaatacgttcccgggccttgtacacaccgcccgtcacaccatggaagcaagtaacacccgaagccggtggcctaacccttgtggagggagccgtcgaaggtgggactcgtgactggggtgaagtcgtaacaaggtagccgtaccggaaggtgcggctggatcacctcctttcta

SEQ ID NO: 8447 - DNA, 1515 bp, Solirubrum puertoriconensis
  ref <308>: DATABASE ACCESSION NUMBER: NCBI ACCESSION: NZ_LNAL01000006.1
  ref <309>: DATABASE ENTRY DATE: 2019-04-01
  ref <313>: RELEVANT RESIDUES IN SEQ ID NO: (1)..(1515)
acaatggagagtttgatcctggctcaggatgaacgctagcggcaggcctaatacatgcaagtcgaacgggcgcagcaatgcgtcagtggcgcacgggtgcgtaacgcgtaggcaatctgcctacacctgggggatagcccgccgaaaggtggattaataccgcatgacaccgcgggccggcatcggctggcggttaaagaatttcgggtgtagatgagcctgcgtgccattagctagttggcggggtaagggcccaccaaggcgacgatggctaggggagctgagaggccgatcccccacactggcactgagatacgggccagactcctacgggaggcagcagtagggaatattgggcaatgggagcaatcctgacccagccatgccgcgtgccggatgaaggccttctgggttgtaaacggcttttgaccgggaagaaaaagcccctgcgggggaaaccgacggtaccggttgaataagcaccggctaactccgtgccagcagccgcggtaatacggagggtgcgagcgttgtccggatttattgggtttaaagggtgcgtaggcggccccgcaagtccgtggtgaaagcctcttgctcaacaagagaactgccatggatactacggggcttgagtccagacgaggttggcggaatggacggtgtagcggtgaaatgcatagataccgtccagaaccccgattgcgtaggcagctgactaggctggtactgacgctgaggcacgaaagcgtggggagcaaacaggattagataccctggtagtccacgccgtaaacgatggatactcgctgtgggcgatatgacggcccgcggcttagcgaaagcgttaagtatcccacctggggagtacgccggcaacggtgaaactcaaaggaattgacgggggcccgcacaagtggtggagcatgtggtttaattcgatgatacgcgaggaaccttacctaggctagaatgcgcgtgaccggttcggagacggacctttccttcgggacacaaagcaaggtgctgcatggccgtcgtcagctcgtgccgtgaggtgttgggttaagtcccgcaacgagcgcaacccctatgtttagttgccagcgcgtcaaggcggggactctagacagactgcctgcgcaagcagcgaggaaggcggggacgacgtcaggtcatcatggcccttacgcctagggctacacacgtgctacaatgggcggtacagcgggttgccacgcagcgatgcggagccaatctcgaaaagccgttctcagttcggatcgcagtctgcaactcgactgcgtgaagctggaatcactagtaatcgcgtatcagcaacgacgcggtgaatacgttcccgggccttgtacacaccgcccgtcaagccatggaagtctggtagacctgaagctggtgctcgtcgcagaagccagttagggtagaacaggtaactggggctaagtcgtaacaaggtagccgtaccggaaggtgcggctggatcacctcctttct

SEQ ID NO: 8448 - DNA, 1517 bp, Solitalea canadensis
  ref <308>: DATABASE ACCESSION NUMBER: NCBI ACCESSION: NC_017770.1
  ref <309>: DATABASE ENTRY DATE: 2019-04-01
  ref <313>: RELEVANT RESIDUES IN SEQ ID NO: (1)..(1517)
ggagagtttgatcctggctcaggatgaacgctagcggcaggcctaatacatgcaagtcgaacgagattagagacttcggtttctatgaaagtggcgcacgggtgcgtaacacgtatgcaacctaccttcaattgggggatagccttccgaaagggagattaataccgcataagatatcagaatggcatcatttagatattaaaactttggtgattgaagatgggcatgcgttgcattagctagttggtaaggtaacggcttaccaaggctacgatgcataggggatctgagaggatggtcccccacactggtactgagatacggaccagactcctacgggaggcagcagtaaggaatattggtcaatggacggaagtctgaaccagccatgccgcgtgcaggaagacggccctatgggttgtaaactgcttttgtcggggaataaacctagatacgtgtatttagttgaaggtacccgaagaataaggatcggctaactccgtgccagcagccgcggtaatacggaggatccaagcgttatccggatttattgggtttaaagggtgcgtaggcggtaaattaagtcagaggtgaaagcctgcagctcaactgtagaactgcctttgatactggtttacttgagtacagatgaagtgggcggaatgtgacaagtagcggtgaaatgcatagatatgtcacagaacaccgattgcgaaggcagctcactaaagtgtaactgacgctgaggcacgaaagcgtggggatcaaacaggattagataccctggtagtccacgccctaaacgatgattactcgctgtcggcgatatacagtcggcggctaagcgaaagcgttaagtaatccacctggggagtacggtcgcaagattgaaactcaaaggaattgacgggggcccgcacaagcggaggagcatgtggtttaattcgatgatacgcgaggaaccttacccgggcttgaaagttagtgaatgatttagaaatagatcagtcagcaatgacacgaaactaggtgctgcatggctgtcgtcagctcgtgccgtgaggtgttgggttaagtcccgcaacgagcgcaacccctatgattagttgccagcattaagatggggactctaatcagactgcctacgcaagtagagaggaaggcggggacgacgtcaagtcatcatggcccttacgtccggggctacacacgtgctacaatggatggtacagagggctgcgacctagtaataggaagccaatctcaaaaagccattcacagttcggattgaggtctgcaactcgacctcatgaagttggattcgctagtaatcgcgtatcagcaatgacgcggtgaatacgttcccgggccttgtacacaccgcccgtcaagccatgaaagccgggggtgcctaaagactgtagccgcaaggagcggtttagggcaaaactggtaattagggctaagtcgtaacaaggtagccgtaccggaaggtgcggctggaatacctcctttct

SEQ ID NO: 8449 - DNA, 1523 bp, Solitalea longa
  ref <308>: DATABASE ACCESSION NUMBER: NCBI ACCESSION: NZ_PQVF01000026.1
  ref <309>: DATABASE ENTRY DATE: 2019-04-01
  ref <313>: RELEVANT RESIDUES IN SEQ ID NO: (1)..(1523)
tacaatggagagtttgatcctggctcaggatgaacgctagcggcaggcctaatacatgcaagtcgaacgagattgaggagcttgctcttcatgaaagtggcgcacgggtgcgtaacacgtatgcaacctaccttcaattgggggatagccttccgaaagggagattaataccgcataaaacagcagaatggcatcatttaactgttaaaactttggtgattgaagatgggcatgcgttgcattagctagttggtaaggtaacggcttaccaaggctacgatgcataggggatctgagaggatggtcccccacactggtactgagatacggaccagactcctacgggaggcagcagtaaggaatattggtcaatggacggaagtctgaaccagccatgccgcgtgcaggatgacggccctatgggttgtaaactgcttttgtcggggaataaacctagatacgtgtatttagttgaaggtacccgaagaataaggatcggctaactccgtgccagcagccgcggtaatacggaggatccaagcgttatccggatttattgggtttaaagggtgcgtaggcggtaaattaagtcagaggtgaaagcctgcagctcaactgtagaactgcctttgatactggtttacttgagtacagatgaagtgggcggaatgtgacaagtagcggtgaaatgcatagatatgtcacagaacaccgattgcgaaggcagctcactaaagtgtaactgacgctgaggcacgaaagcgtggggatcaaacaggattagataccctggtagtccacgccctaaacgatgattactcgctgtcggcgatatacagtcggcggctaagcgaaagcgttaagtaatccacctggggagtacggtcgcaagattgaaactcaaaggaattgacgggggcccgcacaagcggaggagcatgtggtttaattcgatgatacgcgaggaaccttacccgggcttgaaagttactgaagttagtagaaatattaacgtccgcaaggacaggaaactaggtgctgcatggctgtcgtcagctcgtgccgtgaggtgttgggttaagtcccgcaacgagcgcaacccctatgtttagttgccagcattaagatggggactctaaacagactgcctacgcaagtagagaggaaggaggggacgacgtcaagtcatcatggcccttacgtccggggctacacacgtgctacaatggatggtacagagggctgcgacctggtaacaggaagccaatctcaaaaagccattcacagttcggattgaggtctgcaactcgacctcatgaagttggattcgctagtaatcgcgtatcagcaatgacgcggtgaatacgttcccgggccttgtacacaccgcccgtcaagccatgaaagctgggggtgcctaaagactgtagccgcaaggagcggtttagggcaaaactggtaattagggctaagtcgtaacaaggtagccgtaccggaaggtgcggctggaatacctcctttct

SEQ ID NO: 8450 - DNA, 1532 bp, Solobacterium moorei
  ref <308>: DATABASE ACCESSION NUMBER: NCBI ACCESSION: NZ_QRWX01000007.1
  ref <309>: DATABASE ENTRY DATE: 2019-04-01
  ref <313>: RELEVANT RESIDUES IN SEQ ID NO: (1)..(1532)
caaatgaagagtttgatcctggctcaggatgaacgctggcggcgtgcctaatacatgcaagtcgaacgctggagatctagcttgctagatcgaaggagtggcgaacgggtgagtaatacataagcaacctacccacgaagactgggataatctctggaaacggggactaataccggataggtaatcggaaggcatcttctggttattaaaggttaaaaacactggtggatgggcttatggcgcattagttagttggtgaggtaacggcccaccaagacgatgatgcgtagccggcctgagagggtgaacggccacattgggactgagacacggcccagactcctacgggaggcagcagtagggaattttcggcaatgggggcaaccctgaccgagcaacgccgcgtgagtgaagacggccttcgggttgtaaagctctgttgtaagggaagaacggtagatagagaatatctaagtgacggtaccttaccagaaagccacggctaactacgtgccagcagccgcggtaatacgtaggtggcgagcgttatccggaattattgggcgtaaagggtgcgtaggcggcctgttaagtaagtggttaaattgttgggctcaacccaatccagccacttaaactggcaggctagagtattggagaggcaagtggaattccatgtgtagcggtaaaatgcgtagatatatggaggaacaccagtggcgaaggcggcttgctagccaaagactgacgctcatgcacgaaagcgtggggagcaaataggattagataccctagtagtccacgccgtaaacgatgaatactaagtattggggaaactcagtgctgcagctaacgcaataagtattccgcctgtggagtatgcacgcaagtgtgaaacataaaggaattgacgggggcccgcacaagcggtggagtatgtggtttaattcgacgcaacgcgaagaaccttaccaggccttgacatcccttgcaaagctgtagagatacagtagaggttatcaaggagacaggtggtgcatggttgtcgtcagctcgtgtcgtgagatgttgggttaagtcccgcaacgagcgcaacccttgccttcagttaccagcattcagttggggactctggagggactgccggtgataaaccggaggaaggtggggatgacgtcaaatcatcatgccccttatggcctgggctacacacgtactacaatggctgttacaacgtgcagcgacctagcgataggaagcgaatcactaaaagacagtctcagttcggattgaagtctgcaactcgacttcatgaagctggaatcgctagtaatcgcggatcagaatgccgcggtgaatacgttctcgggccttgtacacaccgcccgtcataccatgagagctggtaatacccgaagccggtggcctaaccgcaaggaaggagccgtcgaaggtaggactagtgattggggtcaagtcgtaacaaggtatccctacgagaacgtggggatggatcacctcctttctaagga

SEQ ID NO: 8451 - DNA, 1559 bp, Sorangium cellulosum
  ref <308>: DATABASE ACCESSION NUMBER: NCBI ACCESSION: NZ_CP012672.1
  ref <309>: DATABASE ENTRY DATE: 2019-04-01
  ref <313>: RELEVANT RESIDUES IN SEQ ID NO: (1)..(1559)
taactggagagtttgatcctggctcagaacgaacgttagcggcgcgcttaacacatgcaagtcgagcgagaaagggcttcggccccggtaaagcggcgcacgggtgagtaacacgtaggtaatctgcccccaggtggtggataacgttccgaaaggagcgctaatacagcatgagaccacgtcttcgaaagaggatgaggtcaaagccggcctcttcacgaaagctggcgccaggggatgagcctgcggcccatcagctagttggtagggtaatggcctaccaaggcgaagacgggtagctggtctgagaggatgatcagccacactggaactgagacacggtccagactcctacgggaggcagcagtggggaatcttgcgcaatgggcgaaagcctgacgcagcgacgccgcgtgagtgatgaaggccttcgggttgtaaagctctgtggagggggacgaataagggttggctaacatccagctcgatgacggtacccctttagcaagcaccggctaactctgtgccagcagccgcggtaagacagagggtgcaaacgttgttcggaattactgggcgtaaagcgcatgtaggcggttcgtaaagtcagatgtgaaagccctgggcttaacccaggaagtgcatttgaaactcacgaacttgagtcccggagaggaaggcggaattctcggtgtagaggtgaaattcgtagatatcgagaggaacatcggtggcgaaggcggccttctggacggtgactgacgctgagatgcgaaagcgtggggagcaaacaggattagataccctggtagtccacgccgtaaacgatgggtgctaggtgtcgcgggctttgactcctgcggtgccgtagctaacgcattaagcaccccgcctggggagtacggccgcaaggctaaaactcaaaggaattgacgggggcccgcacaagcggtggagcatgtggttcaattcgacgcaacgcgcagaaccttacctgggctagaaaatgcagggacctggttgaaagatcggggtgctcttcggagaacctgtagttaggtgctgcatggctgtcgtcagctcgtgtcgtgagatgttgggttaagtcccgcaacgagcgcaacccctatcgttagttgccagcggttcggccgggcactctagcgagactgccgatatttaaatcggaggaaggtggggatgacgtcaagtcctcatggcccttatgtccagggctacacacgtgctacaatgggcggtacagacggtcgcgaacccgcgaggggaagccaatccgaaaaaaccgtcctcagtacggataagagtctgcaactcgactctttgaagttggaatcgctagtaatccctgatcagcaggcaggggtgaatacgttcccgggccttgtacacaccgcccgtcacaccatgggagtcgattgctccagaagtggctgcgccaacccgcaagggaggcaggcccccaaggagtggttggtaactggggtgaagtcgtaacaaggtagccgtaggggaacctgcggctggatcacctcctttct

SEQ ID NO: 8452 - DNA, 1538 bp, Sphaerisporangium sp. LHW63015
  ref <308>: DATABASE ACCESSION NUMBER: NCBI ACCESSION: NZ_QMEY01000043.1
  ref <309>: DATABASE ENTRY DATE: 2019-04-01
  ref <313>: RELEVANT RESIDUES IN SEQ ID NO: (1)..(1538)
tgtttggagagtttgatcctggctcaggacgaacgctggcggcgtgcttaacacatgcaagtcgagcggaaaggcccttcggggtactcgagcggcgaacgggtgagtaacacgtgagtaacctgcccctgacttcgggataagcctgggaaaccgggtctaataccgggtatgacctgcatctgcatgggtgtgggtggaaagatttttcggtcggggatgggctcgcggcctatcagcttgttggtggggtagtggcctaccaaggcgacgacgggtagccggcctgagagggcgaccggccacactgggactgagacacggcccagactcctacgggaggcagcagtggggaatattgcgcaatgggcggaagcctgacgcagcgacgccgcgtgggggatgacggccttcgggttgtaaacctctttcggcagggacgaagatgacgtgtacctgttaaagaagtgccggctaactacgtgccagcagccgcggtaatacgtagggcgcgagcgttgtccggaattattgggcgtaaagagctcgtaggtggccggtcgcgtctgccgtgaaagcccatggcttaaccatgggtctgcggtggatacgggccggctagaggtaggcaggggcaagcggaattcctggtgtagcggtgaaatgcgcagatatcaggaggaacaccggtggcgaaggcggcttgctgggccttacctgacgctgaggagcgaaagcgtggggagcgaacaggattagataccctggtagtccacgctgtaaacgttgggcgctaggtgtggggtccttccacggattccgtgccgtagctaacgcattaagcgccccgcctggggagtacggccgcaaggctaaaactcaaaggaattgacgggggcccgcacaagcggcggagcatgttgcttaattcgacgcaacgcgaagaaccttaccaaggtttgacatcgcccggacgtctgcagagatgcaggtttcctttggaccgggtgacaggtggtgcatggctgtcgtcagctcgtgtcgtgagatgttgggttaagtcccgcaacgagcgcaacccttgttccatgttgccagtgagcgcccttttttggggtggcttggggactcatgggagactgccggggtcaactcggaggaaggtggggatgacgtcaagtcatcatgccccttatgtcttgggctgcaaacatgctacaatggtcggtacagagggctgccaagccgtgaggcggagcgaatccctaaaagccggtctcagttcggattggggtctgcaactcgaccccatgaagtcggagtcgctagtaatcgcagatcagcaacgctgcggtgaatacgttcccgggccttgtacacaccgcccgtcacgtcacgaaagtcggcaacacccgaagcccgtggcccaaccaccttgtgtggggggagcggtcgaaggtggggctggcgattgggacgaagtcgtaacaaggtagccgtaccggaaggtgcggctggatcacctcctttctaaggag

SEQ ID NO: 8453 - DNA, 1510 bp, Sphaerobacter thermophilus
  ref <308>: DATABASE ACCESSION NUMBER: NCBI ACCESSION: NC_013523.1
  ref <309>: DATABASE ENTRY DATE: 2019-04-01
  ref <313>: RELEVANT RESIDUES IN SEQ ID NO: (1)..(1510)
gatggagagtttgatcctggctcaggaacaacgctggcggcgtgcctaatgcatgcaagtcgtacgggagccgctttggcggtcgaccgtggcggacgggtgaggaacacgtgggtaacctgccccggcgcgggggataaccgcgggaaaccgtggctaataccccatgggctcggttggggggtggcctgatcgagcaaaggcggaagccgtgccgggaggggcctgcggcctatcagctagacggtggggtaatggcctaccgtggcgatgacgggtagctggtctgagaggacgatcagccacacggggactgagacacggccccgactcctacgggaggcagcagcaaggaattttccgcaatgggcgcaagcctgacggagcgacgccgcgtggaggatgacgcccttcggggtgtaaactccttttcggggggacgaaggcagtgacggtacccccggaagaagcaccggctaactacgtgccagcagccgcggtaagacgtagggtgcgagcgttgtccggagttactgggcgtaaagggcgcgtaggcggctgcccgcgtcgcacgtgaaagcccccggctcaaccggggagggtcgtgcgagacggggtggctagaggcagggagaggctggtggaattcccggtgtagcggtgaaatgcgtagagatcgggaggaacaccggtggcgaaggcggccagctggccctgacctgacgctgaggcgcgaaggcgcggggagcgaacgggattagataccccggtagtccgcgcagtaaacgctgtggactaggtgtgggaggtgttgaccccttccgtgccggcgctaacgcagtaagtccaccgcctggggagtacggccgcaaggctaaaactcaaaggaattgacgggggcccgcacaagcagcggagcgtgtggtttaattcgacgcaacgcgcagaaccttaccagggcttgacatccccggaacccctgggaaaccggggggtgcccttcggggagccgggagacaggtgctgcatggctgtcgtcagctcgtgtcgtgagatgttgggttaagtcccgcaacgagcgcaaccctcgtggctagttacggtggtgtctagccagactgccgggcacaacccggaggaagggggggatgacgtcaagtccgcatggccctgacgccctgggcgacacacacgctacaatggccgggacagcgggcggccaagcggcaacgcggagccaatccctcaaacccggtctcagttcggattgggggctgcaactcgcccccatgaaggcggagttgctagtaaccgcaggtcagccatactgcggtgaatatgttcccgggccttgtacacaccgcccgtcacgtcacgaaagccggcaacacctgaagccggtgggccaacccgatacgggaggcagccgtcgagggtggggctggtgattgggacgaagtcgtaacaaggtagccgtagcggaagctgcggctggatcacctcctttcta

SEQ ID NO: 8454 - DNA, 950 bp, Sphingobacteriales bacterium UPWRP 1
  ref <308>: DATABASE ACCESSION NUMBER: NCBI ACCESSION: NZ_PXYE01000035.1
  ref <309>: DATABASE ENTRY DATE: 2019-04-01
  ref <313>: RELEVANT RESIDUES IN SEQ ID NO: (1)..(950)
acaatggagagtttgatcctggctcaggatgaacgctagcggcgggcttaatacatgcaagtcgaacggtaacaggtcttcggacgctgacgagtggcgcacgggtgcgtaacgcgtacacaacctaccctaaagagggggatagctctgggaaaccgggaataataccccatagtactgctgggttgcatgacaaatcagttaaaggtttactgctttaggatgggtgtgcgagccattaggtagttggagaggtaacggctcaccaagccgacgatggttagctggtctgagaggatgatcagccacacgggcactgagacacgggcccgactcctacgggaggcagcagtaaggaatattggacaatgggcggaagcctgatccagccacgccgcgtgcaggaagaaggtcctatggattgtaaactgcttttgtcagaggcgaaagtgtatgatttatcatattttgacggtatctggcgaataagcaccggctaactacgtgccagcagccgcggtaatacgtagggtgcaagcgttatccggatttactgggtttaaagggtccgcaggcggtctgttaagtcagtggtgaaatagcagggctcaaccttgttgctgccattgatactggcggacttgagaatagtagaggtgggcggaatgtagcatgtagcggtgaaatgcgtagatatgctacagaacaccgattgcgaaggcagctcactggactatttctgacgctaatggacgaaagcgtgggtagcaaacaggattagataccctggtagtccacgccctaaacgatgttcactcgacatgtgtgcgtatgagtatatgtgtctaagcgaaagcgttaagtgaaccacctggggagtacgtcggcaacgatgaaactcaaaggaattgacgggggtccgcacaagcggtggagcatgtggtttaatt

SEQ ID NO: 8455 - DNA, 1537 bp, Sphingobacterium cellulitidis
  ref <308>: DATABASE ACCESSION NUMBER: NCBI ACCESSION: NZ_NOUX01000020.1
  ref <309>: DATABASE ENTRY DATE: 2019-04-01
  ref <313>: RELEVANT RESIDUES IN SEQ ID NO: (1)..(1537)
ttttacaatggagagtttgatcctggctcaggatgaacgctagcggcaggcctaatacatgcaagtcggacgggatccagctggtagcttgctaccggttggtgagagtggcgcacgggtgcgtaacgcgtgagcaacctacccatatcagggggatagcccgaagaaattcggattaacaccgcatgacacaaattgaccgcatggtttatttgtcaaatattcataggatatggatgggctcgcgtgacattagctagttggtggggtaacggcccaccaaggcgacgatgtctaggggctctgagaggagaatcccccacactggtactgagacacggaccagactcctacgggaggcagcagtaaggaatattggtcaatgggggcaaccctgaaccagccatgccgcgtgcaggatgactgccctatgggttgtaaactgcttttgttagggaataaaccccactacgtgtagtgggctgaatgtacctaaagaataaggatcggctaactccgtgccagcagccgcggtaatacggaggatccgagcgttatccggatttattgggtttaaagggtgcgtaggcggcactttaagtcaggggtgaaagacggcagctcaactgtcgcagtgcccttgatactgaagtgcttgaatgcggttgaagacggcggaatgagacaagtagcggtgaaatgcatagatatgtctcagaacaccgattgcgaaggcagctgtctaagccgttattgacgctgatgcacgaaagcgtggggatcgaacaggattagataccctggtagtccacgccctaaacgatgatgactcgatgtttgcgatataccgtaagcgtccaagcgaaagcgttaagtcatccacctggggagtacgcccgcaagggtgaaactcaaaggaattgacgggggcccgcacaagcggaggagcatgtggtttaattcgatgatacgcgaggaaccttacccgggcttgaaagttactgaaggatgcagagacgcatccgtccttcgggacaggaaactaggtgctgcatggctgtcgtcagctcgtgccgtgaggtgttgggttaagtcccgcaacgagcgcaacccctatgtttagttgccagcacgtcaaggtggggactctaaacagactgcctgcgcaagcagagaggaaggcggggacgacgtcaagtcatcatggcccttacgtccggggctacacacgtgctacaatggatggtacagcgggcagctacacagcaatgtgatgccaatctcgaaaagccattcacagttcggatcggggtctgcaactcgaccccgtgaagttggattcgctagtaatcgcgtatcagcaatgacgcggtgaatacgttcccgggccttgtacacaccgcccgtcaagccatgaaagctgggggtacctaaagcatgtaaccgcaaggagcgtgttagggtaaaaccggtaattggggctaagtcgtaacaaggtagccgtaccggaaggtgcggctggaatacctcctttcta

SEQ ID NO: 8456 - DNA, 1534 bp, Sphingobacterium detergens
  ref <308>: DATABASE ACCESSION NUMBER: NCBI ACCESSION: NZ_RAPY01000012.1
  ref <309>: DATABASE ENTRY DATE: 2019-04-01
  ref <313>: RELEVANT RESIDUES IN SEQ ID NO: (1)..(1534)
tacaatggagagtttgatcctggctcaggatgaacgctagcggcaggcctaatacatgcaagtcggacgggatccatcggagagcttgctcgaagatggtgagagtggcgcacgggtgcgtaacgcgtgagcaacctacctctatcagggggatagcctctcgaaagagagattaacaccgcataatatatctgattggcatcagttggatattaaatatttataggatagagatgggctcgcgtgacattagctagttggtagggtaacggcttaccaaggcgacgatgtctaggggctctgagaggagaatcccccacactggtactgagacacggaccagactcctacgggaggcagcagtaaggaatattggtcaatgggcggaagcctgaaccagccatgccgcgtgcaggatgactgccctatgggttgtaaactgcttttgtccaggaataaacctaaatacgagtatttagctgaatgtactggaagaataaggatcggctaactccgtgccagcagccgcggtaatacggaggatccgagcgttatccggatttattgggtttaaagggtgcgtaggcggcctattaagtcaggggtgaaatacggtggctcaaccatcgcagtgcctttgatactgatgggcttgaatccatttgaagtgggcggaataagacaagtagcggtgaaatgcatagatatgtcttagaactccgattgcgaaggcagctcactaagctggtattgacgctgatgcacgaaagcgtggggatcgaacaggattagataccctggtagtccacgccctaaacgatgataactcgatgttggcgatagacagccagcgtcttagcgaaagcgttaagttatccacctggggagtacgcccgcaagggtgaaactcaaaggaattgacgggggcccgcacaagcggaggagcatgtggtttaattcgatgatacgcgaggaaccttacccgggcttgaaagttagtgaagagaccagagacggtctcgtccttcgggacacgaaactaggtgctgcatggctgtcgtcagctcgtgccgtgaggtgttgggttaagtcccgcaacgagcgcaacccctatgtttagttgccagcatgtaatgatggggactctaaacagactgcctgtgcaaacagtgaggaaggtggggacgacgtcaagtcatcatggcccttacgtccggggctacacacgtgctacaatggatggtacagcgggcagctacatagcaatatgatgctaatctctaaaagccattcacagttcggattggggtctgcaactcgaccccatgaagttggattcgctagtaatcgcgtatcagcaatgacgcggtgaatacgttcccgggccttgtacacaccgcccgtcaagccatgaaagttgggggtacctaaagcatgtgaccgcaaggagcgtgttagggtaaaaccgataattggggctaagtcgtaacaaggtagccgtaccggaaggtgcggctggaatacctcctttcta

SEQ ID NO: 8457 - DNA, 847 bp, Sphingobacterium gobiense
  ref <308>: DATABASE ACCESSION NUMBER: NCBI ACCESSION: NZ_PVBS01000010.1
  ref <309>: DATABASE ENTRY DATE: 2019-04-01
  ref <313>: RELEVANT RESIDUES IN SEQ ID NO: (1)..(847)
atttttacaatggagagtttgatcctggctcaggatgaacgctagcggcaggcctaatacatgcaagtcggacgggattgcgccttagcttgctaaggtgcatgagagtggcgcacgggtgcgtaacgcgtgagcaacctgcccatgtcagggggatagcccgttgaaagacggattaacaccgcatgaagatacttaccggcatcggtatgtatccaaatattcataggacatggatgggctcgcgtggcattagctagttggtgcggtaacggcgcaccaaggcgatgatgcctaggggctctgagaggagaatcccccacactggtactgagacacggaccagactcctacgggaggcagcagtagggaatattggtcaatgggcgggagcctgaaccagccatgccgcgtgcgggatgaaggccctatgggtcgtaaaccgcttttatacgggaacaaccgcagctacgtgtagctgtctgagtgtaccgtaggaataaggatcggctaactccgtgccagcagccgcggtaatacggaggatccgagcgttatccggaattattgggtttaaagggtgcgtaggcggctcgttaagtcaggggtgaaatacagcggctcaaccgttgcagtgcctttgatactgacgagcttgaatctggccgaagacggcggaacgggacaagtagcggtgaaatgcatagatatgtcccagaaccccgattgcgaaggcagctgtctagcccagcattgacgctgatgcacgaaagcgtggggatcgaacaggattagataccctggtagtccacgccctaaacgatgatgactcgatgttagcgatata

SEQ ID NO: 8458 - DNA, 1530 bp, Sphingobacterium haloxyli
  ref <308>: DATABASE ACCESSION NUMBER: NCBI ACCESSION: NZ_PVBQ01000040.1
  ref <309>: DATABASE ENTRY DATE: 2019-04-01
  ref <313>: RELEVANT RESIDUES IN SEQ ID NO: (1)..(1530)
tacaatggagagtttgatcctggctcaggatgaacgctagcggcaggcctaatacatgcaagtcggacgggattgtcccttagcttgctaaggggcatgagagtggcgcacgggtgcgtaacgcgtgagcaacctgcccatgtcagggggatagcccgttgaaagacggattaacaccgcatgaagataagctccggcatcggggtttatccaaatattcataggacatggatgggctcgcgtggcattagctggttggtgcggtaacggcgcaccaaggcgatgatgcctaggggctctgagaggagaatcccccacactggtactgagacacggaccagactcctacgggaggcagcagtagggaatattggtcaatgggcgggagcctgaaccagccatgccgcgtgcgggacgaaggccctatgggtcgtaaaccgcttttatacgggaacaaccgcatgtacgagtacatgtctgagtgtaccgtaggaataaggatcggctaactccgtgccagcagccgcggtaatacggaggatccgagcgttatccggaattattgggtttaaagggtgcgtaggcggcgctttaagtcaggggtgaaatacagcggctcaaccgttgcagtgcctttgatactgaagtgcttgaatctggtcgaagacggcggaacgggacaagtagcggtgaaatgcatagatatgtcccagaaccccgattgcgaaggcagctgtctagcccagcattgacgctgatgcacgaaagcgtggggatcgaacaggattagataccctggtagtccacgccctaaacgatgatgactcgatgttagcgatatacggttagcgtccaagcgaaagcgttaagtcatccacctggggagtacggccgcaaggctgaaactcaaaggaattgacgggggcccgcacaagcggaggagcatgtggtttaattcgatgatacgcgaggaaccttacccgggcttgaaagttagcgacggatgcagagacgcatcttcccttcggggcgcgaaactaggtgctgcatggctgtcgtcagctcgtgccgtgaggtgttgggttaagtcccgcaacgagcgcaacccctgtttccagttgccatcgggtcatgccggggactctggagagactgcctgtgcaaacagtgaggaaggcggggacgacgtcaagtcatcatggcccttacgtccggggctacacacgtgctacaatgggcggtacagcgggcagctacctggcaacaggatgcgaatctcccaaagccgcccacagttcggatcggggcctgcaactcggccccgtgaagctggattcgctagtaatcgcgtatcagcaatgacgcggtgaatacgttcccgggccttgtacacaccgcccgtcaagccatgaaagccgggggtgcctaaagcatgtaaccgcaaggagcgtgttagggcaatactggtaattggggctaagtcgtaacaaggtagccgtaccggaaggtgcggctggaatacctcctttc

SEQ ID NO: 8459 - DNA, 1525 bp, Sphingobacterium lactis
  ref <308>: DATABASE ACCESSION NUMBER: NCBI ACCESSION: NZ_FNUT01000020.1
  ref <309>: DATABASE ENTRY DATE: 2019-04-01
  ref <313>: RELEVANT RESIDUES IN SEQ ID NO: (1)..(1525)
tggagagtttgatcctggctcaggatgaacgctagcggcaggcctaatacatgcaagtcggacgggatccagggggtagcttgctaccttctggtgagagtggcgcacgggtgcgtaacgcgtgagcaacctacccatatcagggggatagcccggagaaatccggattaacaccgcatgacacagcaaccccgcatggggacactgttaaatattcataggatatggatgggctcgcgtgacattagctagttggtggggtaacggcccaccaaggcgacgatgtctaggggctctgagaggagaatcccccacactggtactgagacacggaccagactcctacgggaggcagcagtaaggaatattggtcaatgggggcaaccctgaaccagccatgccgcgtgcaggatgactgccctatgggttgtaaactgcttttgtcggggaataaaccccactacgtgtagtgggctgaatgtacccgaagaataaggatcggctaactccgtgccagcagccgcggtaatacggaggatccgagcgttatccggatttattgggtttaaagggtgcgtaggcggcactttaagtcaggggtgaaagacggcagctcaactgtcgcagtgcccttgatactgaagtgcttgaatgcggttgaagacggcggaatgagacaagtagcggtgaaatgcatagatatgtctcagaacaccgattgcgaaggcagctgtctaagccgttattgacgctgatgcacgaaagcgtggggatcgaacaggattagataccctggtagtccacgccctaaacgatgatgactcgatgtttgcgatatacagtaagcgtccaagcgaaagcgttaagtcatccacctggggagtacgcccgcaagggtgaaactcaaaggaattgacgggggcccgcacaagcggaggagcatgtggtttaattcgatgatacgcgaggaaccttacccgggcttgaaagttactgaagcatccagagacggatgcgtccttcgggacaggaaactaggtgctgcatggctgtcgtcagctcgtgccgtgaggtgttgggttaagtcccgcaacgagcgcaacccctatgtttagttgccagcatttaaggtggggactctaaacagactgcctgcgcaagcagagaggaaggcggggacgacgtcaagtcatcatggcccttacgtccggggctacacacgtgctacaatggatggtacagcgggcagctacacagcaatgtgatgccaatctcgaaaagccattcacagttcggatcggggtctgcaactcgaccccgtgaagttggattcgctagtaatcgcgtatcagcaatgacgcggtgaatacgttcccgggccttgtacacaccgcccgtcaagccatgaaagctgggggtgcctaaagcatgtaaccgcaaggagcgtgttagggcaaaaccggtaattggggctaagtcgtaacaaggtagccgtaccggaaggtgcggctggaatacctccttt

SEQ ID NO: 8460 - DNA, 1535 bp, Sphingobacterium mizutaii
  ref <308>: DATABASE ACCESSION NUMBER: NCBI ACCESSION: NZ_LT906468.1
  ref <309>: DATABASE ENTRY DATE: 2019-04-01
  ref <313>: RELEVANT RESIDUES IN SEQ ID NO: (1)..(1535)
ttttacaatggagagtttgatcctggctcaggatgaacgctagcggcaggcctaatacatgcaagtcggacgggatccatcggtagcttgctaccgatggtgagagtggcgcacgggtgcgtaacgcgtgagcaacctgcccatatcagggggatagcccggagaaatccggattaacaccgcatgacactgctttccggcatcgggaggtagtcaaatattcataggatatggatgggctcgcgtgacattagctagttggtggggtaacggcccaccaaggcgacgatgtctaggggctctgagaggagaatcccccacactggtactgagacacggaccagactcctacgggaggcagcagtaaggaatattggtcaatgggggcaaccctgaaccagccatgccgcgtgcaggacgactgccctatgggttgtaaactgcttttgttagggaataaaccccgctacgtgtagcgggctgaatgtacctaaagaataaggatcggctaactccgtgccagcagccgcggtaatacggaggatccgagcgttatccggatttattgggtttaaagggtgcgtaggcggcactttaagtcaggggtgaaagacggcagctcaactgtcgcagtgcccttgatactgaagtgcttgaatgcggttgaagacggcggaatgagacaagtagcggtgaaatgcatagatatgtctcagaacaccgattgcgaaggcagctgtctaagccgttattgacgctgatgcacgaaagcgtggggatcgaacaggattagataccctggtagtccacgccctaaacgatgatgactcgatgtttgcgatataccgtaagcgtccaagcgaaagcgttaagtcatccacctggggagtacgcccgcaagggtgaaactcaaaggaattgacgggggcccgcacaagcggaggagcatgtggtttaattcgatgatacgcgaggaaccttacccgggcttgaaagttactgaagggcgcagagacgcgcccgtccttcgggacaggaaactaggtgctgcatggctgtcgtcagctcgtgccgtgaggtgttgggttaagtcccgcaacgagcgcaacccctatgtttagttgccagcacgtcaaggtggggactctaaacagactgcctgcgcaagcagagaggaaggcggggacgacgtcaagtcatcatggcccttacgtccggggctacacacgtgctacaatggatggtacagcgggcagctacacagcaatgtggtgccaatctcgaaaagccattcacagttcggatcggggtctgcaactcgaccccgtgaagttggattcgctagtaatcgcgtatcagcaatgacgcggtgaatacgttcccgggccttgtacacaccgcccgtcaagccatgaaagctgggggtacctaaagcatgtaaccgcaaggagcgtgttagggtaaaaccggtaattggggctaagtcgtaacaaggtagccgtaccggaaggtgcggctggaatacctcctttcta

SEQ ID NO: 8461 - DNA, 1537 bp, Sphingobacterium multivorum
  ref <308>: DATABASE ACCESSION NUMBER: NCBI ACCESSION: NZ_UAUU01000009.1
  ref <309>: DATABASE ENTRY DATE: 2019-04-01
  ref <313>: RELEVANT RESIDUES IN SEQ ID NO: (1)..(1537)
ttttacaatggagagtttgatcctggctcaggatgaacgctagcggcaggcctaatacatgcaagtcggacgggatccatcggagagcttgctcgaagatggtgagagtggcgcacgggtgcgtaacgcgtgagcaacctacctctatcagggggatagcctctcgaaagagagattaacaccgcataacatcaacagttcgcatgttcggttgattaaatatttataggatagagatgggctcgcgtgacattagctagttggtagggtaacggcttaccaaggcgacgatgtctaggggctctgagaggagaatcccccacactggtactgagacacggaccagactcctacgggaggcagcagtaaggaatattggtcaatgggcggaagcctgaaccagccatgccgcgtgcaggatgactgccctatgggttgtaaactgcttttgtccaggaataaacctaaatacgtgtatttagctgaatgtactggaagaataaggatcggctaactccgtgccagcagccgcggtaatacggaggatccgagcgttatccggatttattgggtttaaagggtgcgtaggcggcctattaagtcaggggtgaaatacggtggctcaaccatcgcagtgcctttgatactgatgggcttgaatccatttgaagtgggcggaataagacaagtagcggtgaaatgcatagatatgtcttagaactccgattgcgaaggcagctcactaagctggtattgacgctgatgcacgaaagcgtggggatcgaacaggattagataccctggtagtccacgccctaaacgatgataactcgatgttggcgatagacagccagcgtcccagcgaaagcgttaagttatccacctggggagtacgcccgcaagggtgaaactcaaaggaattgacgggggcccgcacaagcggaggagcatgtggtttaattcgatgatacgcgaggaaccttacccgggcttgaaagttagtgaagagtgcagagacgcactcgtccttcgggacacgaaactaggtgctgcatggctgtcgtcagctcgtgccgtgaggtgttgggttaagtcccgcaacgagcgcaacccctatgtttagttgccagcatgtcatggtggggactctaaacagactgcctgtgcaaacagagaggaaggtggggacgacgtcaagtcatcatggcccttacgtccggggctacacacgtgctacaatggatggtacagcgggcagctacatagcaatatgatgctaatctctaaaagccattcacagttcggattggggtctgcaactcgaccccatgaagttggattcgctagtaatcgcgtatcagcaatgacgcggtgaatacgttcccgggccttgtacacaccgcccgtcaagccatgaaagttgggggtacctaaagcatgttaccgcaaggagcgtgttagggtaaaaccgataattggggctaagtcgtaacaaggtagccgtaccggaaggtgcggctggaatacctcctttcta

SEQ ID NO: 8462 - DNA, 961 bp, Sphingobacterium sp. 1.A.4
  ref <308>: DATABASE ACCESSION NUMBER: NCBI ACCESSION: NZ_PEAZ01000003.1
  ref <309>: DATABASE ENTRY DATE: 2019-04-01
  ref <313>: RELEVANT RESIDUES IN SEQ ID NO: (1)..(961)
gtggagggctgaatgtacccggagaataaggatcggctaactccgtgccagcagccgcggtaatacggaggatccgagcgttatccggatttattgggtttaaagggtgcgtaggcggcactttaagtcaggggtgaaagacggcagctcaactgtcgcagtgcccttgatactgaagtgcttgaatgcggttgaagacggcggaatgagacaagtagcggtgaaatgcatagatatgtctcagaacaccgattgcgaaggcagctgtctaagccgttattgacgctgatgcacgaaagcgtggggatcgaacaggattagataccctggtagtccacgccctaaacgatgatgactcgatgtttgcgatatacagtaagcgtccaagcgaaagcgttaagtcatccacctggggagtacgcccgcaagggtgaaactcaaaggaattgacgggggcccgcacaagcggaggagcatgtggtttaattcgatgatacgcgaggaaccttacccgggcttgaaagttactgaagcatccagagacggatgcgtccttcgggacaggaaactaggtgctgcatggctgtcgtcagctcgtgccgtgaggtgttgggttaagtcccgcaacgagcgcaacccctatgtttagttgccagcacgtkaaggtggggactctaaacagactgcctgcgcaagcagagaggaaggcggggacgacgtcaagtcatcatggcccttacgtccggggctacacacgtgctacaatggatggtacagcgggcagctacacagcaatgtgatgccaatctcgaaaagccattcacagttcggatcggggtctgcaactcgaccccgtgaagttggattcgctagtaatcgcgtatcagcaatgacgcggtgaatacgttcccgggccttgtacacaccgcccgtcaagccatgaaagctgggggtacctaaa

SEQ ID NO: 8463 - DNA, 1527 bp, Sphingobacterium sp. 1.A.5
  ref <308>: DATABASE ACCESSION NUMBER: NCBI ACCESSION: NZ_PEBA01000043.1
  ref <309>: DATABASE ENTRY DATE: 2019-04-01
  ref <313>: RELEVANT RESIDUES IN SEQ ID NO: (1)..(1527)
tggagagtttgatcctggctcaggatgaacgctagcggcaggcctaatacatgcaagtcggacgggatccgggagtagcttgctacttccggtgagagtggcgcacgggtgcgtaacgcgtgagcaacctgcccatatcagggggatagcccggagaaatccggattaacaccgcatgacacgccgggacggcatcgtycyggcgtcaaatattcataggatatggatgggctcgcgtgacattagctagttggtggggtaacggcccaccaaggcgacgatgtctaggggctctgagaggagaatcccccacactggtactgagacacggaccagactcctacgggaggcagcagtaaggaatattggtcaatgggggcaaccctgaaccagccatgccgcgtgcaggacgactgccctatgggttgtaaactgcttttgccggggaataaaccccactacgtgtagtgggctgaacgtacccggagaataaggatcggctaactccgtgccagcagccgcggtaatacggaggatccgagcgttatccggatttattgggtttaaagggtgcgtaggcggcactttaagtcaggggtgaaagacggcagctcaactgtcgcagtgcccttgatactgaagtgcttgaatgcggttgaagacggcggaatgagacaagtagcggtgaaatgcatagatatgtctcagaacaccgattgcgaaggcagctgtctaagccgttattgacgctgatgcacgaaagcgtggggatcgaacaggattagataccctggtagtccacgccctaaacgatgataactcgatgtttgcgatataccgtaagcgtccaagcgaaagcgttaagttatccacctggggagtacgcccgcaagggtgaaactcaaaggaattgacgggggcccgcacaagcggaggagcatgtggtttaattcgatgatacgcgaggaaccttacccgggcttgaaagttactgaagcatccagagacggatgcgtccttcgggacaggaaactaggtgctgcatggctgtcgtcagctcgtgccgtgaggtgttgggttaagtcccgcaacgagcgcaacccctatgtccagttgccagcacktaaaggtggggactctggacagactgcctgcgcaagcagagaggaaggcggggacgacgtcaagtcatcatggcccttacgtccggggctacacacgtgctacaatggatggtacagcgggcagctacacagcaatgtgatgccaatctcgaaaagccattcacagttcggatcggggtctgcaactcgaccccgtgaagttggattcgctagtaatcgcgtatcagcaatgacgcggtgaatacgttcccgggccttgtacacaccgcccgtcaagccatgaaagctgggggtacctaaagcatgtaaccgcaaggagcgtgttagggtaaaaccggtaattggggctaagtcgtaacaaggtagccgtaccggaaggtgcggctggaatacctcctttcta

SEQ ID NO: 8464 - DNA, 1521 bp, Sphingobacterium sp. 21
  ref <308>: DATABASE ACCESSION NUMBER: NCBI ACCESSION: NC_015277.1
  ref <309>: DATABASE ENTRY DATE: 2019-04-01
  ref <313>: RELEVANT RESIDUES IN SEQ ID NO: (1)..(1521)
tggagagtttgatcctggctcaggatgaacgctagcggcaggcctaatacatgcaagtcgaacgggatcgggggcttcggtccccgtgagagtggcgcacgggtgcgtaacgcgtgagcaacctgcccgtcccagggggatagcccggagaaatccggattaataccgcatgagaatgcaggtccgcatgggccttcatttaaatattcataggggacggatgggctcgcgtgacattagctggttggcggggtaacggcccaccaaggcgacgatgtctaggggctctgagaggagaaacccccacactggtactgagacacggaccagactcctacgggaggcagcagtaaggaatattggtcaatggggggaaccctgaaccagccatgccgcgtgcaggaagacggccctacgggttgtaaactgcttttgcacgggaataacccccggtatgtataccgggctgaatgtaccgtgagaataaggatcggctaactccgtgccagcagccgcggtaatacggaggatccgagcgttatccggaattattgggtttaaagggtgcgtaggcggcgcgctaagtcaggggtgaaagacggtggctcaaccatcgcagtgcctttgatactggcgcgcttgaatgtacctgaggtaggcggaatgtggcaagtagcggtgaaatgcatagatatgccacagaacaccgattgcgaaggcagcttaccaaagtacgattgacgctgaggcacgaaagcgtggggatcgaacaggattagataccctggtagtccacgccctaaacgatgaacactcgatgtcggcgatagacagtcggcgtccaagcgaaagcgttaagtgttccacctggggagtacgcccgcaagggtgaaactcaaaggaattgacgggggcccgcacaagcggaggagcatgtggtttaattcgatgatacgcgaggaaccttacccgggcttgaaagttactgaattgtccagagatggacaagtccttcgggacaggaaactaggtgctgcatggctgtcgtcagctcgtgccgtgaggtgttgggttaagtcccgcaacgagcgcaacccctatgtttagttgccagcacgtcaaggtggggactctaaacagactgcctgtgcaaacagagaggaaggcggggacgacgtcaagtcatcatggcccttacgtccggggctacacacgtgctacaatggggggtacagagggcagcgacaccgcgaggtgaagccaatctcagaaagcccctcacagttcggatcggggtctgcaactcgaccccgtgaagttggattcgctagtaatcgcgtatcagcaatgacgcggtgaatacgttcccgggccttgtacacaccgcccgtcaagccatgaaagccgggggtacctaaagcatgtaaccgcaaggagcgtgtcagggtaaaaccggtaattggggctaagtcgtaacaaggtagccgtaccggaaggtgcggctggaatacctcctttcta

SEQ ID NO: 8465 - DNA, 1530 bp, Sphingobacterium sp. 30C10-4-7
  ref <308>: DATABASE ACCESSION NUMBER: NCBI ACCESSION: NZ_SGIT01000009.1
  ref <309>: DATABASE ENTRY DATE: 2019-04-01
  ref <313>: RELEVANT RESIDUES IN SEQ ID NO: (1)..(1530)
tacaatggagagtttgatcctggctcaggatgaacgctagcggcaggcctaatacatgcaagtcggacgggattccagtgtagcttgctatactggatgagagtggcgcacgggtgcgtaacgcgtgagcaacctgcccatgtcagggggatagcccgttgaaagacggattaataccgcataacacataagtaccgcatggttcttatgtcaaatatttataggacatggatgggctcgcgtggcattagctagttggtaaggtaacggcttaccaaggcgatgatgcctaggggctctgagaggagtgacccccacactggtactgagacacggaccagactcctacgggaggcagcagtagggaatattggtcaatgggcgggagcctgaaccagccatgccgcgtgcgggaagaaggccctatgggtcgtaaaccgcttttatacgggaacaaccgcatgtacgtgtacgtgcctgagtgtaccgtaggaataaggatcggctaactccgtgccagcagccgcggtaatacggaggatccgagcgttatccggaattattgggtttaaagggtgcgtaggcggcactttaagtcaggggtgaaatacagcggctcaaccgttgcagtgcccttgatactgaagtgcttgaattcggacgaaggaggcggaacgggacaagtagcggtgaaatgcatagatatgtcccagaaccccgattgcgaaggcagcttcctaggccgatattgacgctgatgcacgaaagcgtggggatcgaacaggattagataccctggtagtccacgccctaaacgatgatgactcgatgtttgcgatatattgtaagcgtccaagcgaaagcgttaagtcatccacctggggagtacgatcgcaagattgaaactcaaaggaattgacgggggcccgcacaagcggaggagcatgtggtttaattcgatgatacgcgaggaaccttacccgggcttgaaagttagcgacggtatcagagacggtacttcccttcggggcgcgaaactaggtgctgcatggctgtcgtcagctcgtgccgtgaggtgttgggttaagtcccgcaacgagcgcaacccctatgtttagttgccagcacgttaaggtggggactctaaacagactgccggcgtaagccgcgaggaaggtggggacgacgtcaagtcatcatggcccttacgtccggggctacacacgtgctacaatgggcggtacagcgggaagctacctggcaacaggatgcggatctcgaaaagccgtccacagttcggatcggggcctgcaactcggccccgtgaagctggattcgctagtaatcgcgtatcagcaatgacgcggtgaatacgttcccgggccttgtacacaccgcccgtcaagccatgaaagccgggggtgcctaaagcatgtaaccgcaaggagcgtgtcagggcaatactggtaattggggctaagtcgtaacaaggtagccgtaccggaaggtgcggctggaatacctcctttc

SEQ ID NO: 8466 - DNA, 1537 bp, Sphingobacterium sp. G1-14
  ref <308>: DATABASE ACCESSION NUMBER: NCBI ACCESSION: NZ_CP021381.1
  ref <309>: DATABASE ENTRY DATE: 2019-04-01
  ref <313>: RELEVANT RESIDUES IN SEQ ID NO: (1)..(1537)
ttttacaatggagagtttgatcctggctcaggatgaacgctagcggcaggcctaatacatgcaagtcggacgggatccatcggagagcttgctcgaagatggtgagagtggcgcacgggtgcgtaacgcgtgagcaacctacctctatcagggggatagcctctcgaaagagagattaacaccgcataacatatctgaccggcatcggttagctattaaatatttataggatagagatgggctcgcgtgacattagctagttggtagggtaacggcttaccaaggcgacgatgtctaggggctctgagaggagaatcccccacactggtactgagacacggaccagactcctacgggaggcagcagtaaggaatattggtcaatgggcggaagcctgaaccagccatgccgcgtgcaggaagactgccctatgggttgtaaactgcttttgtccaggaataaacctagatacgtgtatctagctgaatgtactggaagaataaggatcggctaactccgtgccagcagccgcggtaatacggaggatccgagcgttatccggatttattgggtttaaagggtgcgtaggcggcctattaagtcaggggtgaaatacggtggctcaaccatcgcagtgcctttgatactgatgggcttgaatccatttgaagtgggcggaataagacaagtagcggtgaaatgcatagatatgtcttagaactccgattgcgaaggcagctcactaagctggtattgacgctgatgcacgaaagcgtggggatcgaacaggattagataccctggtagtccacgccctaaacgatgataactcgatgttggcgatagacagccagcgtcccagcgaaagcgttaagttatccacctggggagtacgcccgcaagggtgaaactcaaaggaattgacgggggcccgcacaagcggaggagcatgtggtttaattcgatgatacgcgaggaaccttacccgggcttgaaagttagtgaagagtgcagagacgcactcgtccttcgggacacgaaactaggtgctgcatggctgtcgtcagctcgtgccgtgaggtgttgggttaagtcccgcaacgagcgcaacccctatgtttagttgccagcatgtaatggtggggactctaaacagactgcctgtgcaaacagagaggaaggtggggacgacgtcaagtcatcatggcccttacgtccggggctacacacgtgctacaatggatggtacagcgggcagctacatagcaatatgatgctaatctctaaaagccattcacagttcggattggggtctgcaactcgaccccatgaagttggattcgctagtaatcgcgtatcagcaatgacgcggtgaatacgttcccgggccttgtacacaccgcccgtcaagccatgaaagttgggggtacctaaagcatgttaccgaaaggagcgtgttagggtaaaaccgataattggggctaagtcgtaacaaggtagccgtaccggaaggtgcggctggaatacctcctttcta

SEQ ID NO: 8467 - DNA, 804 bp, Sphingobacterium sp. HMA12
  ref <308>: DATABASE ACCESSION NUMBER: NCBI ACCESSION: NZ_BEYR01000011.1
  ref <309>: DATABASE ENTRY DATE: 2019-04-01
  ref <313>: RELEVANT RESIDUES IN SEQ ID NO: (1)..(804)
gatagggatgggctcgcgtgacattagctagttggtagggtaacggcttaccaaggcgacgatgtctaggggctctgagaggagaatcccccacactggtactgagacacggaccagactcctacgggaggcagcagtaaggaatattggtcaatgggcggaagcctgaaccagccatgccgcgtgcaggatgactgccctatgggttgtaaactgcttttgtccaggaataaacccaggtacgtgtacctggctgaatgtactggaagaataaggatcggctaactccgtgccagcagccgcggtaatacggaggatccgagcgttatccggatttattgggtttaaagggtgcgtaggcggcctattaagtcaggggtgaaatacggtggctcaaccatcgcagtgcctttgatactgatgggcttgaatccatttgaagtgggcggaataagacaagtagcggtgaaatgcatagatatgtcttagaactccgattgcgaaggcagctcactaagctggtattgacgctgatgcacgaaagcgtggggatcgaacaggattagataccctggtagtccacgccctaaacgatgataactcgatgttggcgatagacagccagcgtcccagcgaaagcgttaagttatccacctggggagtacgcccgcaagggtgaaactcaaaggaattgacgggggcccgcacaagcggaggagcatgtggtttaattcgatgatacgcgaggaaccttacccgggcttgaaagttagtgaagggagcagagacgcttccgtccttcgg

SEQ ID NO: 8468 - DNA, 1532 bp, Sphingobacterium sp. JB170
  ref <308>: DATABASE ACCESSION NUMBER: NCBI ACCESSION: NZ_FUKU01000064.1
  ref <309>: DATABASE ENTRY DATE: 2019-04-01
  ref <313>: RELEVANT RESIDUES IN SEQ ID NO: (1)..(1532)
tacaatggagagtttgatcctggctcaggatgaacgctagcggcaggcctaatacatgcaagtcgaacgggattccagtgtagcttgctatactggatgagagtggcgtacgggtgcgtaacgcgtgagcaacctacccatatcagggggatagcccggagaaatccggattaacaccgcataatattactgaatggcatcatttagtgatcaaatatttataggatatggatgggctcgcgtgacattagctagttggtaaggtaacggcttaccaaggctacgatgtctaggggctctgagaggagaatcccccacactggtactgagacacggaccagactcctacgggaggcagcagtaaggaatattggtcaatggagggaactctgaaccagccatgccgcgtgcaggatgactgccctacgggttgtaaactgcttttatctaggaataacccttggtacgtgtaccgagctgaatgtactagaagaataaggatcggctaactccgtgccagcagccgcggtaatacggaggatccgagcgttatccggatttattgggtttaaagggtgcgtaggcggcctgttaagtcaggagtgaaatacggcagctcaactgtcgcagtgctcttgatactgataggcttgaatgtcgctgaagatggcggaatgagacaagtagcggtgaaatgcatagatatgtctcagaacaccgattgcgaaggcagctgtctaaacgattattgacgctgatgcacgaaagcgtggggatcaaacaggattagataccctggtagtccacgccctaaacgatgataactcgatgttagcgatatactgttagcgtcccagcgaaagcgttaagttatccacctggggagtacgcccgcaagggtgaaactcaaaggaattgacgggggcccgcacaagcggaggagtatgtggtttaattcgatgatacgcgaggaaccttacccgggcttgaaagttagtgaaggtagcagagacgctaccgtccttcgggacacgaaactaggtgctgcatggctgtcgtcagctcgtgccgtgaggtgttgggttaagtcccgcaacgagcgcaacccctatgtttagttgccagcacgttaaggtggggactctaaacagactgcctgcgcaagcagtgaggaaggcggggacgacgtcaagtcatcatggcccttacgtccggggctacacacgtactacaatggatggtacagcgggcagctaggcagcaatgtcatgctaatctctaaaagccattcacagttcggatcggggtctgcaactcgaccccgtgaagttggattcgctagtaatcgcgtatcagcaatgacgcggtgaatacgttcccgggccttgtacacaccgcccgtcaagccatgaaagttgggggtgcctaaagcatgtaaccgcaaggagcgtgttagggcaaaaccgataattggggctaagtcgtaacaaggtagccgtaccggaaggtgcggctggaatacctcctttcta

SEQ ID NO: 8469 - DNA, 1056 bp, Sphingobacterium sp. M05W1-28
  ref <308>: DATABASE ACCESSION NUMBER: NCBI ACCESSION: NZ_RBWS01000047.1
  ref <309>: DATABASE ENTRY DATE: 2019-04-01
  ref <313>: RELEVANT RESIDUES IN SEQ ID NO: (1)..(1056)
gctgaatgtactggaagaataaggatcggctaactccgtgccagcagccgcggtaatacggaggatccgagcgttatccggatttattgggtttaaagggtgcgtaggcggcctgttaagtcaggggtgaaatacggtggctcaaccatcgcagtgcctttgatactgacgggcttgaatccatttgaagtgggcggaataagacaagtagcggtgaaatgcatagatatgtcttagaactccgattgcgaaggcagctcactaagctggtattgacgctgatgcacgaaagcgtggggatcgaacaggattagataccctggtagtccacgccctaaacgatgataactcgatgttggcgatagaccgccagcgtccaagcgaaagcgttaagttatccacctggggagtacgcccgcaagggtgaaactcaaaggaattgacgggggcccgcacaagcggaggagcatgtggtttaattcgatgatacgcgaggaaccttacccgggcttgaaagttagtgaaggatgcagagacgcatccgtccttcgggacacgaaactaggtgctgcatggctgtcgtcagctcgtgccgtgaggtgttgggttaagtcccgcaacgagcgcaacccctatgtttagttgccagcaagtaatgttggggactctaaacagactgcctgcgcaagcagagaggaaggtggggacgacgtcaagtcatcatggcccttacgtccggggctacacacgtgctacaatggatggtacagcgggcagctacatagcaatatggtgctaatctctaaaagccattcacagttcggattggggtctgcaactcgaccccatgaagttggattcgctagtaatcgcgtatcagcaatgacgcggtgaatacgttcccgggccttgtacacaccgcccgtcaagccatgaaagttgggggtacctaaagcatgtgaccgcaaggagcgtgttagggtaaaaccgataattggggctaagtcgtaacaaggtagccgtaccggaaggtgcggctggaatacctcctttcta

SEQ ID NO: 8470 - DNA, 1533 bp, Sphingobacterium sp. M46
  ref <308>: DATABASE ACCESSION NUMBER: NCBI ACCESSION: NZ_QCXX01000005.1
  ref <309>: DATABASE ENTRY DATE: 2019-04-01
  ref <313>: RELEVANT RESIDUES IN SEQ ID NO: (1)..(1533)
tacaatggagagtttgatcctggctcaggatgaacgctagcggcaggcctaatacatgcaagtcggacgggatccatcggagagcttgctcaaagatggtgagagtggcgcacgggtgcgtaacgcgtgagcaacctacctctatcagggggatagcctctcgaaagagagattaacaccgcataatataactattcggcatcgtctggttattaaatatttataggatagagatgggctcgcgtgacattagctagttggtagggtaacggcttaccaaggcgacgatgtctaggggctctgagaggagaatcccccacactggtactgagacacggaccagactcctacgggaggcagcagtaaggaatattggtcaatgggcggaagcctgaaccagccatgccgcgtgcaggatgactgccctatgggttgtaaactgcttttgtccgggaataaacccaggtacgtgtacctggctgaatgtaccggaagaataaggatcggctaactccgtgccagcagccgcggtaatacggaggatccgagcgttatccggatttattgggtttaaagggtgcgtaggcggcccattaagtcaggggtgaaatacggtggctcaaccatcgcagtgcctttgatactgatgggcttgaatccatttgaagtgggcggaataagacaagtagcggtgaaatgcatagatatgtcttagaactccgattgcgaaggcagctcactaagctggtattgacgctgatgcacgaaagcgtggggatcgaacaggattagataccctggtagtccacgccctaaacgatgataactcgatgttggcgatagacagccagcgtcccagcgaaagcgttaagttatccacctggggagtacgcccgcaagggtgaaactcaaaggaattgacgggggcccgcacaagcggaggagcatgtggtttaattcgatgatacgcgaggaaccttacccgggcttgaaagttagtgaaggatgcagagacgcatccgtccttcgggacacgaaactaggtgctgcatggctgtcgtcagctcgtgccgtgaggtgttgggttaagtcccgcaacgagcgcaacccctatgtttagttgccagcatgtaatggtggggactctaaacagactgcctgtgcaaacagtgaggaaggtggggacgacgtcaagtcatcatggcccttacgtccggggctacacacgtgctacaatggatggtacagcgggcagctacatagcaatatgatgctaatctctaaaagccattcacagttcggattggggtctgcaactcgaccccatgaagttggattcgctagtaatcgcgtatcagcaatgacgcggtgaatacgttcccgggccttgtacacaccgcccgtcaagccatgaaagttgggggtacctaaagcatgtgaccgcaaggagcgtgttagggtaaaaccgataattggggctaagtcgtaacaaggtagccgtaccggaaggtgcggctggaatacctcctttct

SEQ ID NO: 8471 - DNA, 664 bp, Sphingobium abikonense
  ref <308>: DATABASE ACCESSION NUMBER: NCBI ACCESSION: NZ_BCYT01000047.1
  ref <309>: DATABASE ENTRY DATE: 2019-04-01
  ref <313>: RELEVANT RESIDUES IN SEQ ID NO: (1)..(664)
agggaatattggacaatgggcgcaagcctgatccagcaatgccgcgtgagtgatgaaggccttagggttgtaaagctcttttaccagagatgataatgacagtatctggggaataagccccggctaactccgtgccagcagccgcggtaatacggagggggctagcgttgttcggaattactgggcgtaaagcgcacgtaggcggcgatttaagtcagaggtgaaagcccggggctcaaccccggaactgcctttgagactggattgcttgaatccgggagaggtgagtggaattccgagtgtagaggtgaaattcgtagatattcggaagaacaccagtggcgaaggcggctcactggaccggcattgacgctgaggtgcgaaagcgtggggagcaaacaggattagataccctggtagtccacgccgtaaacgatgataactagctgccggggcacatggtgtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcgatttccagagatggatttcttcagttcggctggatgagtg

SEQ ID NO: 8472 - DNA, 1495 bp, Sphingobium amiense
  ref <308>: DATABASE ACCESSION NUMBER: NCBI ACCESSION: NZ_AP018664.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaatacatgcaagtcgaacgagatcttcggatctagtggcgcacgggtgcgtaacgcgtgggaatctgcccttgggttcggaataacgtcgggaaactgacgctaataccggatgatgacgtaagtccaaagatttatcgcccagggatgagcccgcgtaggattagctagttggtggggtaaaggcctaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggcgatttaagtcagaggtgaaagcccggggctcaaccccggaactgcctttgagactggattgcttgaatcctggagaggtgagtggaattccgagtgtagaggtgaaattcgtagatattcggaagaacaccagtggcgaaggcggctcactggacaggtattgacgctgaggtgcgaaagcgtggggagcaaacaggattagataccctggtagtccacgccgtaaacgatgataactagctgccggggcacatggtgtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggatcgtggagacactttccttcagttcggctggataggtgacaggtgctgcatggctgtcgtcagctcgtgtcgtgagatgttgggttaagtcccgcaacgagcgcaaccctcgcctttagttgccagcatttagttgggtactctaaaggaaccgccggtgataagccggaggaaggtggggatgacgtcaagtcctcatggcccttacgcgttgggctacacacgtgctacaatggcgactacagtgggcagcgacctcgcgaggggaagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggattcactcgaaggcgttgagctaacccgcaagggaggcaggcgaccacagtgggtttagcgactggggtgaagtcgtaacaaggtagccgtaggggaacctgcggctggatcacctcctttctaag

SEQ ID NO: 8473 - DNA, 1496 bp, Sphingobium baderi
  ref <308>: DATABASE ACCESSION NUMBER: NCBI ACCESSION: NZ_CP013264.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcctaatacatgcaagtcgaacgagatcttcggatctagtggcgcacgggtgcgtaacgcgtgggaatctgcccttgggttcggaataacagttggaaacgactgctaataccggatgatgacgtaagtccaaagatttatcgcccagggatgagcccgcgtaggattagctagttggtgaggtaaaggctcaccaaggcgacgatccttagctggtctgagaggatgatcagccacactgggactgagacacggcccagactcctacgggaggcagcagtagggaatattggacaatgggcgcaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggcgatttaagtcagaggtgaaagcccggggctcaaccccggaatagcctttgagactggattgcttgaatccgggagaggtgagtggaattccgagtgtagaggtgaaattcgtagatattcggaagaacaccagtggcgaaggcggctcactggaccggcattgacgctgaggtgcgaaagcgtggggagcaaacaggattagataccctggtagtccacgccgtaaacgatgataactagctgctggggctcatggagtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctagtatggattgtggagacacattccttcagttcggctggctaggtgacaggtgctgcatggctgtcgtcagctcgtgtcgtgagatgttgggttaagtcccgcaacgagcgcaaccctcgcctttagttgccatcatttagttgggcactctaaaggaaccgccggtgataagccggaggaaggtggggatgacgtcaagtcctcatggcccttacgcgttgggctacacacgtgctacaatggcgactacagtgggcagccactccgcgaggaggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgcaaggaggcaggcgaccacagtgggtttagcgactggggtgaagtcgtaacaaggtagccgtaggggaacctgcggctggatcacctcctttctaagga

SEQ ID NO: 8474 - DNA, 1322 bp, Sphingobium barthaii
  ref <308>: DATABASE ACCESSION NUMBER: NCBI ACCESSION: NZ_BATN01000197.1
  ref <309>: DATABASE ENTRY DATE: 2019-04-01
  ref <313>: RELEVANT RESIDUES IN SEQ ID NO: (1)..(1322)
aagtccaaagatttatcgcccagggatgagcccgcgtaggattagctagttggtgaggtaaaggctcaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcagaggtgaaagcccggggctcaaccccggaatagcctttgagactggattgcttgaacatcggagaggtgagtggaattccgagtgtagaggtgaaattcgtagatattcggaagaacaccagtggcgaaggcggctcactggacgattgttgacgctgaggtgcgaaagcgtggggagcaaacaggattagataccctggtagtccacgccgtaaacgatgataactagctgctggggctcatggagtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatcctcatcgcgatttccagagatggatttcttcagttcggctggatgagtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcgactacagtgggcagcgaccatgcgagtggaagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgcgctaaccgcaaggaggcagctgaccacggtgggatcagcgactggggtgaagtcgtaacaaggtagccgtaggggaacctgcggctggatcacctcctttctaag

SEQ ID NO: 8475 - DNA, 1497 bp, Sphingobium chinhatense
  ref <308>: DATABASE ACCESSION NUMBER: NCBI ACCESSION: NZ_AUDA01000057.1
  ref <309>: DATABASE ENTRY DATE: 2019-04-01
  ref <313>: RELEVANT RESIDUES IN SEQ ID NO: (1)..(1497)
tcaaacttgagagtttgatcctggctcagaacgaacgctggcggcatgcctaatacatgcaagtcgaacgatcccttcggggatagtggcgcacgggtgcgtaacgcgtgggaatctgcccttgggttcggaataacgtctggaaacggacgctaataccggatgatgtcgataagaccaaagatttatcgcccagggatgagcccgcgtaggattagctagttggtggggtaaaggctcaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcaggggtgaaagcccggtgctcaacaccggaactgcccttgagactggattgcttgaatcacggagaggtgggtggaattccgagtgtagaggtgaaattcgtagatattcggaagaacaccagtggcgaaggcggcccactggacgtgtattgacgctgaggtgcgaaagcgtggggagcaaacaggattagataccctggtagtccacgccgtaaacgatgataactagctgctggggcgcatggcgtttcagtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggtttccagagatggataccttcagttcggctggataggtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcgactacagtgggcagccactccgcgaggaggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgcaaggaggcaggcgaccacagtgggtttagcgactggggtgaagtcgtaacaaggtagccgtaggggaacctgcggctggatcacctcctttctaagga

SEQ ID NO: 8476 - DNA, 1496 bp, Sphingobium chlorophenolicum
  ref <308>: DATABASE ACCESSION NUMBER: NCBI ACCESSION: NZ_BCZC01000309.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcctaatacatgcaagtcgaacgagaccttcgggtctagtggcgcacgggtgcgtaacgcgtgggaatctgcccttgggttcggaataacatcgggaaactgatgctaataccggatgatgacgtaagtccaaagatttatcgcccagggatgagcccgcgtaggattagctagttggtgaggtaaaggctcaccaaggcgacgatccttagctggtctgagaggatgatcagccacactgggactgagacacggcccagactcctacgggaggcagcagtagggaatattggacaatgggcgaaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcaggggtgaaagcccggtgctcaacaccggaactgcccttgagactggattgcttgaatcacggagaggtgggtggaattccgagtgtagaggtgaaattcgtagatattcggaagaacaccagtggcgaaggcggcccactggacgtgtattgacgctgaggtgcgaaagcgtggggagcaaacaggattagataccctggtagtccacgccgtaaacgatgataactagctgctggggtgcatggcatttcagtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggttagtggagacactttccttcagttcggctggataggtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcgactacagtgggcagccactccgcgaggaggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgcaaggaggcaggcgaccacagtgggtttagcgactggggtgaagtcgtaacaaggtagccgtaggggaacctgcggctggatcacctcctttctaagga

SEQ ID NO: 8477 - DNA, 1510 bp, Sphingobium chungbukense
  ref <308>: DATABASE ACCESSION NUMBER: NCBI ACCESSION: NZ_LBIC01000001.1
  ref <309>: DATABASE ENTRY DATE: 2019-04-01
  ref <313>: RELEVANT RESIDUES IN SEQ ID NO: (1)..(1510)
tcaaacttgagagtttgatcctggctcagaacgaacgctggcggcatgcctaatacatgcaagtcgaacgagaccttcgggtctagtggcgcacgggtgcgtaacgcgtgggaatctgcccttgggttcggaataacgtttggaaacgaacgctaataccggatgatgacgccaaagagatttggagtccaaagatttatcgcccaaggatgagcccgcgtaggattagctagttggtaaggtaaaggcttaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcaggggtgaaagcccagtgctcaacactggaactgcccttgagactggattgcttgaatcacggagaggtgggtggaattccgagtgtagaggtgaaattcgtagatattcggaagaacaccagtggcgaaggcggcccactggacgtgtattgacgctgaggtgcgaaagcgtggggagcaaacaggattagataccctggtagtccacgccgtaaacgatgataactagctgctggggtgcatggcatttcagtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggttaccagagatggtttccttcagttcggctggataggtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcgactacagtgggcagccactccgcgaggaggagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggattcactcgaaggcgttgagctaacccgcaagggaggcaggcgaccacagtgggtttagcgactggggtgaagtcgtaacaaggtagccgtaggggaacctgcggctggatcacctcctttctaagga

SEQ ID NO: 8478 - DNA, 1493 bp, Sphingobium cloacae
  ref <308>: DATABASE ACCESSION NUMBER: NCBI ACCESSION: NZ_AP017655.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaatacatgcaagtcgaacgagatcttcggatctagtggcgcacgggtgcgtaacgcgtgggaatctgcccttgggttcggaataacatcgggaaactgatgctaataccggatgatgacgaaagtccaaagatttatcgcccagggatgagcccgcgtaggattagctagttggtggggtaaaggctcaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggcgatttaagtcagaggtgaaagcccggggctcaaccccggaatagcctttgagactggattgcttgaatccgggagaggtgagtggaattccgagtgtagaggtgaaattcgtagatattcggaagaacaccagtggcgaaggcggctcactggaccggcattgacgctgaggtgcgaaagcgtggggagcaaacaggattagataccctggtagtccacgccgtaaacgatgataactagctgctggggctcatggagtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctagtatggttaccagagatggtttccttcagttcggctggctaggtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcgactacagtgggcagcgacctcgcgaggggaagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggattcactcgaaggcgttgagctaaccgcaaggaggcaggcgaccacagtgggtttagcgactggggtgaagtcgtaacaaggtagccgtaggggaacctgcggctggatcacctcctttctaag

SEQ ID NO: 8479 - DNA, 1493 bp, Sphingobium cupriresistens
  ref <308>: DATABASE ACCESSION NUMBER: NCBI ACCESSION: NZ_SEOO01000083.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaatacatgcaagtcgaacgagaccttcgggtctagtggcgcacgggtgcgtaacgcgtgggaatctgcccttgggttcggaataacgtcgggaaactgacgctaataccggatgatatcgaaagatcaaagatttatcgcccagggatgagcccgcgtaggattagctagttggtggggtaaaggctcaccaaggctacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgagatgataatgacagtatcgggagaataagctccggctaactccgtgccagcagccgcggtaatacggagggagctagcgttgttcggaattactgggcgtaaagcgcacgtaggcggcgatttaagtcagaggtgaaagcccggggctcaaccccggaactgcctttgagactggattgctagaatcttggagaggcgggtggaattccgagtgtagaggtgaaattcgtagatattcggaagaacaccagtggcgaaggcggcccgctggacaagtattgacgctgaggtgcgaaagcgtggggagcaaacaggattagataccctggtagtccacgccgtaaacgatgataactagctgccggggcacatggtgtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcgatttccagagatggatatcttcagttcggctggatgagtgacaggtgctgcatggctgtcgtcagctcgtgtcgtgagatgttgggttaagtcccgcaacgagcgcaaccctcgcctttagttgccagcatttggttgggtactctaaaggaaccgccggtgataagccggaggaaggtggggatgacgtcaagtcctcatggcccttacgcgctgggctacacacgtgctacaatggcgactacagtgggcagccactccgcgaggaggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgcaaggaggcaggcgaccacagtgggtttagcgactggggtgaagtcgtaacaaggtagccgtaggggaacctgcggctggatcacctcctttctaag

SEQ ID NO: 8480 - DNA, 1496 bp, Sphingobium czechense
  ref <308>: DATABASE ACCESSION NUMBER: NCBI ACCESSION: NZ_KQ130434.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcctaatacatgcaagtcgaacgagatcttcgggtctagtggcgcacgggtgcgtaacgcgtgggaatctgcccttgggttcggaataacgtcgggaaactgacgctaataccggatgatatcgaaagatcaaagatttatcgcccagggatgagcccgcgtaggattagctagttggtggggtaaaggctcaccaaggctacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgagatgataatgacagtatcgggagaataagctccggctaactccgtgccagcagccgcggtaatacggagggagctagcgttgttcggaattactgggcgtaaagcgcacgtaggcggcgatttaagtcagaggtgaaagcccggggctcaaccccggaactgcctttgagactggattgctagaatcttggagaggcgggtggaattccgagtgtagaggtgaaattcgtagatattcggaagaacaccagtggcgaaggcggcccgctggacaagtattgacgctgaggtgcgaaagcgtggggagcaaacaggattagataccctggtagtccacgccgtaaacgatgataactagctgccggggcacatggtgtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcgatttccagagatggatatcttcagttcggctggatgagtgacaggtgctgcatggctgtcgtcagctcgtgtcgtgagatgttgggttaagtcccgcaacgagcgcaaccctcgcctttagttgccagcatttggttgggtactctaaaggaaccgccggtgataagccggaggaaggtggggatgacgtcaagtcctcatggcccttacgcgctgggctacacacgtgctacaatggcgactacagtgggcagccactccgcgaggaggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgcaaggaggcaggcgaccacagtgggtttagcgactggggtgaagtcgtaacaaggtagccgtaggggaacctgcggctggatcacctcctttctaagga

SEQ ID NO: 8481 - DNA, 1256 bp, Sphingobium francense
  ref <308>: DATABASE ACCESSION NUMBER: NCBI ACCESSION: NZ_SEOM01000033.1
  ref <309>: DATABASE ENTRY DATE: 2019-04-01
  ref <313>: RELEVANT RESIDUES IN SEQ ID NO: (1)..(1256)
caccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcaggggtgaaagcccggtgctcaacaccggaactgcccttgagactggattgcttgaatcacggagaggtgggtggaattccgagtgtagaggtgaaattcgtagatattcggaagaacaccagtggcgaaggcggcccactggacgtgtattgacgctgaggtgcgaaagcgtggggagcaaacaggattagataccctggtagtccacgccgtaaacgatgataactagctgctggggcgcatggcgtttcagtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggtttccagagatggataccttcagttcggctggataggtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcgactacagtgggcagccactccgcgaggaggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgcaaggaggcaggcgaccacagtgggtttagcgactggggtgaagtcgtaacaaggtagccgtaggggaacctgcggctggatcacctcctttctaag

SEQ ID NO: 8482 - DNA, 1493 bp, Sphingobium fuliginis
  ref <308>: DATABASE ACCESSION NUMBER: NCBI ACCESSION: NZ_SEON01000018.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaatacatgcaagtcgaacgagcctttcggggctagtggcgcacgggtgcgtaacgcgtgggaatctgcccttgggttcggaataacgtctggaaacggacgctaataccggatgatgacgaaagtccaaagatttatcgcccagggatgagcccgcgtaggattagctagttggtgaggtaaaggctcaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcagaggtgaaagcccggggctcaaccccggaatagcctttgagactggattgcttgaacatcggagaggtgagtggaattccgagtgtagaggtgaaattcgtagatattcggaagaacaccagtggcgaaggcggctcactggacgattgttgacgctgaggtgcgaaagcgtggggagcaaacaggattagataccctggtagtccacgccgtaaacgatgataactagctgctggggctcatggagtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatcctcatcgcgatttccagagatggatttcttcagttcggctggatgagtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcgactacagtgggcagcgaccatgcgagtggaagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgcgctaaccgcaaggaggcagctgaccacggtgggatcagcgactggggtgaagtcgtaacaaggtagccgtaggggaacctgcggctggatcacctcctttctaag

SEQ ID NO: 8483 - DNA, 1497 bp, Sphingobium indicum
  ref <308>: DATABASE ACCESSION NUMBER: NCBI ACCESSION: NZ_CP013070.1
  ref <309>: DATABASE ENTRY DATE: 2019-04-01
  ref <313>: RELEVANT RESIDUES IN SEQ ID NO: (1)..(1497)
tcaaacttgagagtttgatcctggctcagaacgaacgctggcggcatgcctaatacatgcaagtcgaacgagaccttcgggtctagtggcgcacgggtgcgtaacgcgtgggaatctgcccttgggttcggaataacgtctggaaacggacgctaataccggatgatgtcgataagaccaaagatttatcgcccagggatgagcccgcgtaggattagctagttggtggggtaaaggctcaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcaggggtgaaagcccggtgctcaacaccggaactgcccttgagactggattgcttgaatcacggagaggtgggtggaattccgagtgtagaggtgaaattcgtagatattcggaagaacaccagtggcgaaggcggcccactggacgtgtattgacgctgaggtgcgaaagcgtggggagcaaacaggattagataccctggtagtccacgccgtaaacgatgataactagctgctggggcgcatggcgtttcagtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggtttccagagatggataccttcagttcggctggataggtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcgactacagtgggcagccactccgcgaggaggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgcaaggaggcaggcgaccacagtgggtttagcgactggggtgaagtcgtaacaaggtagccgtaggggaacctgcggctggatcacctcctttctaagga

SEQ ID NO: 8484 - DNA, 1498 bp, Sphingobium japonicum
  ref <308>: DATABASE ACCESSION NUMBER: NCBI ACCESSION: NZ_CAVK010000090.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaatacatgcaagtcgaacgatcccttcggggatagtggcgcacgggtgcgtaacgcgtgggaatctgcccttgggttcggaataacttcgggaaactgaagctaataccggatgatgacgaaagtccaaagatttatcgcccagggatgagcccgcgtaggattagctagttggtggggtaaaggctcaccaaggcaacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgagatgataatgacagtatcgggagaataagctccggctaactccgtgccagcagccgcggtaatacggagggagctagcgttgttcggaattactgggcgtaaagcgcacgtaggcggcgatttaagtcagaggtgaaagcccggggctcaaccccggaactgcctttgagactggattgctagaatcttggagaggcgagtggaattccgagtgtagaggtgaaattcgtagatattcggaagaacaccagtggcgaaggcggctcgctggacaagtattgacgctgaggtgcgaaagcgtggggagcaaacaggattagataccctggtagtccacgccgtaaacgatgataactagctgccggggcacatggtgtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcgatttccagagatggatatcttcagttcggctggatgagtgacaggtgctgcatggctgtcgtcagctcgtgtcgtgagatgttgggttaagtcccgcaacgagcgcaaccctcgcctttagttgccagcatttggttgggtactctaaaggaaccgccggtgataagccggaggaaggtggggatgacgtcaagtcctcatggcccttacgcgctgggctacacacgtgctacaatggcgactacagtgggctgcaaccgtgcgagcggtagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggatttggattcacccgaaggcactgcgttaacccgcaagggagacaggtgaccacggtgggtttagagactggggtgaagtcgtaacaaggtagccgtaggggaacctgcggctggatcacctcctttctaagga

SEQ ID NO: 8485 - DNA, 1509 bp, Sphingobium lactosutens
  ref <308>: DATABASE ACCESSION NUMBER: NCBI ACCESSION: NZ_ATDP01000055.1
  ref <309>: DATABASE ENTRY DATE: 2019-04-01
  ref <313>: RELEVANT RESIDUES IN SEQ ID NO: (1)..(1509)
tcaaacttgagagtttgatcctggctcagaacgaacgctggcggcatgcctaatacatgcaagtcgaacgagatcttcggatctagtggcgcacgggtgcgtaacgcgtgggaatctgcccttgggttcggaataacagttggaaacgactgctaataccggatgatgacgccaaagagatttggagtccaaagatttatcgcccagggatgagcccgcgtaggattagctagttggtggggtaaaggcctaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttaccagagatgataatgacagtatctggggaataagccccggctaactccgtgccagcagccgcggtaatacggagggggctagcgttgttcggaattactgggcgtaaagcgcacgtaggcggcgatttaagtcagaggtgaaagcccggggctcaaccccggaactgcctttgagactggattgcttgaatccgggagaggtgagtggaattccgagtgtagaggtgaaattcgtagatattcggaagaacaccagtggcgaaggcggctcactggaccggcattgacgctgaggtgcgaaagcgtggggagcaaacaggattagataccctggtagtccacgccgtaaacgatgataactagctgccggggcacatggtgtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcgatttccagagatggatttcttcagttcggctggatgagtgacaggtgctgcatggctgtcgtcagctcgtgtcgtgagatgttgggttaagtcccgcaacgagcgcaaccctcgcctttagttgccagcaagcaagttgggtactctaaaggaaccgccggtgataagccggaggaaggtggggatgacgtcaagtcctcatggcccttacgcgctgggctacacacgtgctacaatggcgactacagtgggcagcgacctcgcgagggggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgcaaggaggcaggcgaccacagtgggtttagcgactggggtgaagtcgtaacaaggtagccgtaggggaacctgcggctggatcacctcctttctaagga

SEQ ID NO: 8486 - DNA, 1494 bp, Sphingobium lucknowense
  ref <308>: DATABASE ACCESSION NUMBER: NCBI ACCESSION: NZ_JANF02000063.1
  ref <309>: DATABASE ENTRY DATE: 2019-04-01
  ref <313>: RELEVANT RESIDUES IN SEQ ID NO: (1)..(1494)
caaacttgagagtttgatcctggctcagaacgaacgctggcggcatgcctaatacatgcaagtcgaacgatcccttcggggatagtggcgcacgggtgcgtaacgcgtgggaatctgcccttgggttcggaataacgtctggaaacggacgctaataccggatgatgtcgataagaccaaagatttatcgcccagggatgagcccgcgtaggattagctagttggtggggtaaaggcccaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcaggggtgaaagcccggtgctcaacaccggaactgcccttgagactggattgcttgaatcacggagaggtgggtggaattccgagtgtagaggtgaaattcgtagatattcggaagaacaccagtggcgaaggcggcccactggacgtgtattgacgctgaggtgcgaaagcgtggggagcaaacaggattagataccctggtagtccacgccgtaaacgatgataactagctgctggggcgcatggcgtttcagtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggtttccagagatggataccttcagttcggctggataggtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcgactacagtgggcagccactccgcgaggaggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgcaaggaggcaggcgaccacagtgggtttagcgactggggtgaagtcgtaacaaggtagccgtaggggaacctgcggctggatcacctcctttctaag

SEQ ID NO: 8487 - DNA, 1498 bp, Sphingobium phenoxybenzoativorans
  ref <308>: DATABASE ACCESSION NUMBER: NCBI ACCESSION: NZ_MINO01000024.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgagaccttcgggtctagtggcgcacgggtgcgtaacgcgtgggaatctgcccttgggttcggaataacttcgggaaactgaagctaataccggatgatgacgtaagtccaaagatttatcgcccaaggatgagcccgcgtaggattagctagttggtggggtaaaggcccaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgagatgataatgacagtatcgggagaataagctccggctaactccgtgccagcagccgcggtaatacggagggagctagcgttgttcggaattactgggcgtaaagcgcacgtaggcggcgatctaagtcagaggtgaaagcccggggctcaaccccggaattgcctttgagactggattgcttgaatccgggagaggtgagtggaattccgagtgtagaggtgaaattcgtagatattcggaagaacaccagtggcgaaggcggctcactggaccggcattgacgctgaggtgcgaaagcgtggggagcaaacaggattagataccctggtagtccacgccgtaaacgatgataactagctgtctgggtgcatggcacttaggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcgttttccagagatggattacttcagttcggctggatgagtgacaggtgctgcatggctgtcgtcagctcgtgtcgtgagatgttgggttaagtcccgcaacgagcgcaaccctcgcctttagttgccagcatttagttgggtactctaaaggaaccgccggtgataagccggaggaaggtggggatgacgtcaagtcctcatggcccttacacgctgggctacacacgtgctacaatggcgactacagtgggcagcgacctcgcgaggggaagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaactcgcaagagaggcaggcgaccacggtgggtttagcgactggggtgaagtcgtaacaaggtagccgtaggggaacctgcggctggatcacctcctttctaagga

SEQ ID NO: 8488 - DNA, 1498 bp, Sphingobium quisquiliarum
  ref <308>: DATABASE ACCESSION NUMBER: NCBI ACCESSION: NZ_ATHO01000107.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaatacatgcaagtcgaacgatctcttcggagatagtggcgcacgggtgcgtaacgcgtgggaatctgcccttgggttcggaataacgtcgggaaactgacgctaataccggatgatgacgtaagtccaaagatttatcgcccagggatgagcccgcgtaggattagctagttggttgggtaaaggctgaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcagaggtgaaagcccggggctcaaccccggaatagcctttgagactggattgcttgaacatcggagaggtgagtggaattccgagtgtagaggtgaaattcgtagatattcggaagaacaccagtggcgaaggcggctcactggacgattgttgacgctgaggtgcgaaagcgtggggagcaaacaggattagataccctggtagtccacgccgtaaacgatgataactagctgctggggtgcatggcatttcagtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggttagtggagacactttccttcagttcggctggataggtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcgactacagtgggcagcgaccatgcgagtggaagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggattcactcgaaggcgttgagctaacccgcaagggaggcaggcgaccacagtgggtttagcgactggggtgaagtcgtaacaaggtagccgtaggggaacctgcggctggatcacctcctttctaagga

SEQ ID NO: 8489 - DNA, 1493 bp, Sphingobium sp. 20006FA
  ref <308>: DATABASE ACCESSION NUMBER: NCBI ACCESSION: NZ_LYMJ01000003.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaatacatgcaagtcgaacgagccyttcggggytagtggcgcacgggtgcgtaacgcgtgggaatctgcccttgggttcggaataacgtctggaaacggacgctaataccggatgatgacgaaagtccaaagatttatcgcccagggatgagcccgcgtaggattagctagttggtgaggtaaaggctcaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcagaggtgaaagcccggggctcaaccccggaatagcctttgagactggattgcttgaacatcggagaggtgagtggaattccgagtgtagaggtgaaattcgtagatattcggaagaacaccagtggcgaaggcggctcactggacgattgttgacgctgaggtgcgaaagcgtggggagcaaacaggattagataccctggtagtccacgccgtaaacgatgataactagctgctggggctcatggagtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatcctcatcgcgatttccagagatggatttcttcagttcggctggatgagtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcgactacagtgggcagcgaccatgcgagtggaagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgcgctaaccgcaaggaggcagctgaccacggtgggatcagcgactggggtgaagtcgtaacaaggtagccgtaggggaacctgcggctggatcacctcctttctaag

SEQ ID NO: 8490 - DNA, 1496 bp, Sphingobium sp. 22B
  ref <308>: DATABASE ACCESSION NUMBER: NCBI ACCESSION: NZ_LTAB01000011.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcctaatacatgcaagtcgaacgagccyttcggggytagtggcgcacgggtgcgtaacgcgtgggaatctgcccttgggttcggaataacgtctggaaacggacgctaataccggatgatgacgaaagtccaaagatttatcgcccagggatgagcccgcgtaggattagctagttggtgaggtaaaggctcaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcagaggtgaaagcccggggctcaaccccggaatagcctttgagactggattgcttgaacatcggagaggtgagtggaattccgagtgtagaggtgaaattcgtagatattcggaagaacaccagtggcgaaggcggctcactggacgattgttgacgctgaggtgcgaaagcgtggggagcaaacaggattagataccctggtagtccacgccgtaaacgatgataactagctgctggggctcatggagtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatcctcatcgcgatttccagagatggatttcttcagttcggctggatgagtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcgactacagtgggcagcgaccatgcgagtggaagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgcgctaaccgcaaggaggcagctgaccacggtgggatcagcgactggggtgaagtcgtaacaaggtagccgtaggggaacctgcggctggatcacctcctttctaagga

SEQ ID NO: 8491 - DNA, 1368 bp, Sphingobium sp. AEW4
  ref <308>: DATABASE ACCESSION NUMBER: NCBI ACCESSION: NZ_PYGL01000054.1
  ref <309>: DATABASE ENTRY DATE: 2019-04-01
  ref <313>: RELEVANT RESIDUES IN SEQ ID NO: (1)..(1368)
ggctcagaacgaacgctggcggcatgcctaatacatgcaagtcgaacgagatcttcggatctagtggcgcacgggtgcgtaacgcgtgggaatctgcccttgggttcggaataacttcgggaaactgaagctaataccggatgatgacgaaagtccaaagatttatcgcccagggatgagcccgcgtaggattagctagttggtggggtaaaggctcaccaaggcaacgatccttagctggtctgagaggatgatcagccacactgggactgagacacggcccagactcctacgggaggcagcagtagggaatattggacaatgggcgaaagcctgatccagcaatgccgcgtgagtgatgaaggccttagggttgtaaagctcttttacccgagatgataatgacagtatcgggagaataagctccggctaactccgtgccagcagccgcggtaatacggagggagctagcgttgttcggaattactgggcgtaaagcgcacgtaggcggcgatttaagtcagaggtgaaagcccggggctcaaccccggaactgcctttgagactggattgctagaatcttggagaggcgagtggaattccgagtgtagaggtgaaattcgtagatattcggaagaacaccagtggcgaaggcggctcgctggacaagtattgacgctgaggtgcgaaagcgtggggagcaaacaggattagataccctggtagtccacgccgtaaacgatgataactagctgccggggcacatggtgtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcggatttcagagatgatttccttcagttcggctggatgagtgacaggtgctgcatggctgtcgtcagctcgtgtcgtgagatgttgggttaagtcccgcaacgagcgcaaccctcgcctttagttgccagcatttggttgggtactctaaaggaaccgccggtgataagccggaggaaggtggggatgacgtcaagtcctcatggcccttacgcgctgggctacacacgtgctacaatggcgactacagtgggctgcaaccgtgcgagcggtagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggatttggattcacccgaaggcactgcg

SEQ ID NO: 8492 - DNA, 1496 bp, Sphingobium sp. AM; identical to SEQ ID NO: 8490
  ref <308>: DATABASE ACCESSION NUMBER: NCBI ACCESSION: NZ_LRUK01000004.1
  ref <309>: DATABASE ENTRY DATE: 2019-04-01
  ref <313>: RELEVANT RESIDUES IN SEQ ID NO: (1)..(1496)

SEQ ID NO: 8493 - DNA, 1498 bp, Sphingobium sp. AP49
  ref <308>: DATABASE ACCESSION NUMBER: NCBI ACCESSION: NZ_AJVL01000072.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaatacatgcaagtcgaacgaactcttcggagttagtggcgcacgggtgcgtaacgcgtgggaatctgcccttgggttcggaataacttctggaaacggaagctaataccggatgatgacgtaagtccaaagatttatcgcccaaggatgagcccgcgtaggattagctagttggtgaggtaaaggctcaccaaggcgacgatccttagctggtctgagaggatgatcagccacactgggactgagacacggcccagactcctacgggaggcagcagtagggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggttattcaagtcaggggtgaaagcccagtgctcaacactggaactgcccttgaaactagataacttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcagggcacatggtgttttggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggatcgtggagacactttccttcagttcggctggataggtgacaggtgctgcatggctgtcgtcagctcgtgtcgtgagatgttgggttaagtcccgcaacgagcgcaaccctcgcctttagttgccagcatttagttgggtactctaaaggaaccgccggtgataagccggaggaaggtggggatgacgtcaagtcctcatggcccttacgcgttgggctacacacgtgctacaatggcgactacagtgggcagcgacctcgcgaggggaagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcacccgaaggcgctgcgctaactcgcaagagaggcaggcgaccacggtgggtttagcgactggggtgaagtcgtaacaaggtagccgtaggggaacctgcggctggatcacctcctttctaagga

SEQ ID NO: 8494 - DNA, 1498 bp, Sphingobium sp. Ant17
  ref <308>: DATABASE ACCESSION NUMBER: NCBI ACCESSION: NZ_JEMV01000055.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaatacatgcaagtcgaacgatcctttcggggatagtggcgcacgggtgcgtaacgcgtgggaatctgcccttgggttcggaataacagttggaaacgactgctaataccggatgatgacgtaagtccaaagatttatcgcccagggatgagcccgcgtaggattagctagttggtggggtaaaggcctaccaaggcgacgatccttagctggtctgagaggatgatcagccacactgggactgagacacggcccagactcctacgggaggcagcagtagggaatattggacaatgggcgaaagcctgatccagcaatgccgcgtgagtgatgaaggccttagggttgtaaagctcttttacccgagatgataatgacagtatcgggagaataagctccggctaactccgtgccagcagccgcggtaatacggagggagctagcgttgttcggaattactgggcgtaaagcgcacgtaggcggcgatttaagtcagaggtgaaagcccggggctcaaccccggaactgcctttgagactggattgctagaatcttggagaggcgagtggaattccgagtgtagaggtgaaattcgtagatattcggaagaacaccagtggcgaaggcggctcgctggacaagtattgacgctgaggtgcgaaagcgtggggagcaaacaggattagataccctggtagtccacgccgtaaacgatgataactagctgctggggcacatggtgtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcggatttcagagatgatttccttcagttcggctggatgagtgacaggtgctgcatggctgtcgtcagctcgtgtcgtgagatgttgggttaagtcccgcaacgagcgcaaccctcgcctttagttgccagcattaagttgggtactctaaaggaaccgccggtgataagccggaggaaggtggggatgacgtcaagtcctcatggcccttacgcgctgggctacacacgtgctacaatggcgactacagtgggctgcaaccgtgcgagcggtagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggatttggattcacccgaaggcactgcgctaactcgcaagagaggcaggtgaccacggtgggtttagagactggggtgaagtcgtaacaaggtagccgtaggggaacctgcggctggatcacctcctttctaagga

SEQ ID NO: 8495 - DNA, 1624 bp, Sphingobium sp. C100
  ref <308>: DATABASE ACCESSION NUMBER: NCBI ACCESSION: NZ_AYOY01000055.1
  ref <309>: DATABASE ENTRY DATE: 2019-04-01
  ref <313>: RELEVANT RESIDUES IN SEQ ID NO: (1)..(1624)
tcaaacttgagagtttgatcctggctcagaacgaacgctggcggcatgcctaatacatgcaagtcgaacgagatcttcggatctagtggcgcccgggcgcgtaacgcgtgggactctgcccttgggttcgggataacagttggaaacgactgctaataccggatgatgacgccaaagagatttggagtccaaagatttatcgcccagggatgagcccgcgtaggatgagctagttggtggggtaaaggcttgccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttaccagagatgataatgacagtatctggggaataagccccggctaactccgtgccagcagccgcggtaatacggagggggctagcgttgttcggaattactgggcgtaaagcgcacgtaggcggcgatttaagtcagaggtgaaagcccggggctcaaccccggaacagcctttgagactggattgcttgaatccgggagaggtgagtggaattccgagtgtagaggtgaaattcgtagatattcggaagaacaccagtggcgaaggcggctcactggaccggcattgacgctgaggtgcgaaagcgtggggagcaaacaggattagataccgtggtagtccacgccgtaaacgatgataactagctgccggggcacatggtgtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcgatttccagagatggatttcttcagttcggctggataggtgacaggtgctgcatggctgtcgtcagctcgtgtcgtgagatgttgggttaagtcccgcaacgagcgcaaccctcgcctttagttgccagcatttggttgggtactctaaaggaaccgccggtgagaagccggaggaaggtggggatgacgtcaagtcctcatggcccttacgcgttgggctacacacgtgctacaatggcgactacagtgggcagcgacctcgcgaggggaagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgcaaggaggcaggcgaccacagtgggtcagcatgccgcggcgaatacggtcccaggccttgtacacaccgcccgccacaccatgggagttggattcactcgaaggcgttgagctaaccgcaaggaggcaggcgaccacagtgggtttagcgactggggtgaagtcgtaacaaggtagccgtaggggaacctgcggctggatcacctcctttctaag

SEQ ID NO: 8496 - DNA, 1510 bp, Sphingobium sp. CCH11-B1
  ref <308>: DATABASE ACCESSION NUMBER: NCBI ACCESSION: NZ_LSJY01000164.1
  ref <309>: DATABASE ENTRY DATE: 2019-04-01
  ref <313>: RELEVANT RESIDUES IN SEQ ID NO: (1)..(1510)
tcaaacttgagagtttgatcctggctcagaacgaacgctggcggcatgcctaatacatgcaagtcgaacgagatcttcggatctagtggcgcacgggtgcgtaacgcgtgggaatctgcccttgggttcggaataacgtcgggaaactgacgctaataccggatgatgacgccaaagagatttggagtccaaagatttatcgcccagggatgagcccgcgtaggattagctagttggtggggtaaaggcctaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttaccagagatgataatgacagtatctggggaataagccccggctaactccgtgccagcagccgcggtaatacggagggggctagcgttgttcggaattactgggcgtaaagcgcacgtaggcggcgatttaagtcagaggtgaaagcccggggctcaaccccggaactgcctttgagactggattgcttgaatccgggagaggtgagtggaattccgagtgtagaggtgaaattcgtagatattcggaagaacaccagtggcgaaggcggctcactggaccggcattgacgctgaggtgcgaaagcgtggggagcaaacaggattagataccctggtagtccacgccgtaaacgatgataactagctgccggggcacatggtgtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcggatttcagagatgatttccttcagttcggctggatgagtgacaggtgctgcatggctgtcgtcagctcgtgtcgtgagatgttgggttaagtcccgcaacgagcgcaaccctcgcctttagttgccagcatttggttgggtactctaaaggaaccgccggtgataagccggaggaaggtggggatgacgtcaagtcctcatggcccttacgcgctgggctacacacgtgctacaatggcgactacagtgggcagcgacctcgcgagggggagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggattcactcgaaggcgttgagctaaccagcaatggaggcaggcgaccacagtgggtttagcgactggggtgaagtcgtaacaaggtagccgtaggggaacctgcggctggatcacctcctttctaagga

SEQ ID NO: 8497 - DNA, 1493 bp, Sphingobium sp. CHR27
  ref <308>: DATABASE ACCESSION NUMBER: NCBI ACCESSION: NZ_SBKP01000002.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaatacatgcaagtcgaacgaacacttcggtgttagtggcgcacgggtgcgtaacgcgtgggaatctacccttgggttcggaataacagttagaaatgactgctaataccggatgatgacgtaagtccaaagatttatcgcccaaggatgagcccgcgtaggattagcttgttggtgaggtaaaagctcaccaaggcgacgatccttagctggtctgagaggatgatcagccacactgggactgagacacggcccagactcctacgggaggcagcagtagggaatattggacaatgggggaaaccctgatccagcaatgccgcgtgagtgatgaaggccttagggttgtaaagctcttttacccgagatgataatgacagtatcgggagaataagctccggctaactccgtgccagcagccgcggtaatacggagggagctagcgttgttcggaattactgggcgtaaagcgcacgtaggcggcgatctaagtcagaggtgaaagcccggggctcaaccccggaattgcctttgagactggattgctagaatccgggagaggtgagtggaattccgagtgtagaggtgaaattcgtagatattcggaagaacaccagtggcgaaggcggctcactggaccggcattgacgctgaggtgcgaaagcgtggggagcaaacaggattagataccctggtagtccacgccgtaaacgatgataactagctgtctgggctcacagagttcaggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccttatcgcgattagaggagactcttttcttcagttcggctggataagtgacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgttgggctacacacgtgctacaatggcgactacagtgggttgctacctcgcgagaggatgctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggattcactcgaaggcgttgagctaacccgcaagggaggcaggcgaccacagtgggtttagcgactggggtgaagtcgtaacaaggtagccgtaggggaacctgcggctggatcacctcctttcta

SEQ ID NO: 8498 - DNA, 1498 bp, Sphingobium sp. DC-2; identical to SEQ ID NO: 8488
  ref <308>: DATABASE ACCESSION NUMBER: NCBI ACCESSION: NZ_JNAC01000088.1
  ref <309>: DATABASE ENTRY DATE: 2019-04-01
  ref <313>: RELEVANT RESIDUES IN SEQ ID NO: (1)..(1498)

SEQ ID NO: 8499 - DNA, 1495 bp, Sphingobium sp. EO9
  ref <308>: DATABASE ACCESSION NUMBER: NCBI ACCESSION: NZ_QVRA01000059.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaatacatgcaagtcgaacgagatcttcggatctagtggcgcacgggtgcgtaacgcgtgggaatctacccttgggttcggaataacttcgggaaactgaagctaataccggatgatgtcgaaagaccaaagatttatcgcccagggatgagcccgcgtaggattagctagttggtggggtaaaggctcaccaaggcaacgatccttagctggtctgagaggatgatcagccacactgggactgagacacggcccagactcctacgggaggcagcagtagggaatattggacaatgggcgcaagcctgatccagcaatgccgcgtgagtgatgaaggccttagggttgtaaagctcttttacccgagatgataatgacagtatcgggagaataagctccggctaactccgtgccagcagccgcggtaatacggagggagctagcgttgttcggaattactgggcgtaaagcgcacgtaggcggcgatttaagtcagaggtgaaagcccggggctcaaccccggaactgcctttgagactggattgctagaatcacggagaggtgggtggaattccgagtgtagaggtgaaattcgtagatattcggaagaacaccagtggcgaaggcggcccactggacgtgtattgacgctgaggtgcgaaagcgtggggagcaaacaggattagataccctggtagtccacgccgtaaacgatgataactagctgccggggcacatggtgtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcgatttccagagatggatttcttcagttcggctggatgagtgacaggtgctgcatggctgtcgtcagctcgtgtcgtgagatgttgggttaagtcccgcaacgagcgcaaccctcgcctttagttgccagcatttggttgggtactctaaaggaaccgccggtgataagccggaggaaggtggggatgacgtcaagtcctcatggcccttacgcgctgggctacacacgtgctacaatggcgactacagtgggctgcaaccgggcgaccggtagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggatttggattcacccgaaggcactgcgctaactcgcaagagaggcaggtgaccacggtgggtttagagactggggtgaagtcgtaacaaggtagccgtaggggaacctgcggctggatcacctcctttctaag

SEQ ID NO: 8500 - DNA, 1496 bp, Sphingobium sp. EP60837
  ref <308>: DATABASE ACCESSION NUMBER: NCBI ACCESSION: NZ_CP015986.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcctaatacatgcaagtcgaacgagatcttcggatctagtggcgcacgggtgcgtaacgcgtgggaatctgcccttgggttcggaataacagttggaaacgactgctaataccggatgatgacgtaagtccaaagatttatcgcccaaggatgagcccgcgtaggattagctagttggtaaggtaaaggcttaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcagaggtgaaagcccggggctcaaccccggaatagcctttgagactggattgcttgaacatcggagaggtgagtggaattccgagtgtagaggtgaaattcgtagatattcggaagaacaccagtggcgaaggcggctcactggacgattgttgacgctgaggtgcgaaagcgtggggagcaaacaggattagataccctggtagtccacgccgtaaacgatgataactagctgctggggtgcatggcatttcagtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggatcgtggagacactttccttcagttcggctggataggtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcgactacagtgggcagcgaccatgcgagtggaagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggtttcacccgaaggcagtgcgctaaccgcaaggaggcagctgaccacggtgggatcagcgactggggtgaagtcgtaacaaggtagccgtaggggaacctgcggctggatcacctcctttctaagga

SEQ ID NO: 8501 - DNA, 1498 bp, Sphingobium sp. GW456-12-10-14-TSB1
  ref <308>: DATABASE ACCESSION NUMBER: NCBI ACCESSION: NZ_NGUN01000003.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaatacatgcaagtcgaacgagaccttcgggtctagtggcgcacgggtgcgtaacgcgtgggaatctgcccttgggttcggaataacttcgggaaactgaagctaataccggatgatgacgaaagtccaaagatttatcgcccagggatgagcccgcgtaggattagctagttggtggggtaaaggctcaccaaggcaacgatccttagctggtctgagaggatgatcagccacactgggactgagacacggcccagactcctacgggaggcagcagtagggaatattggacaatgggcgaaagcctgatccagcaatgccgcgtgagtgatgaaggccttagggttgtaaagctcttttacccgagatgataatgacagtatcgggagaataagctccggctaactccgtgccagcagccgcggtaatacggagggagctagcgttgttcggaattactgggcgtaaagcgcacgtaggcggcgatttaagtcagaggtgaaagcccggggctcaaccccggaactgcctttgagactggattgctagaatcttggagaggcgagtggaattccgagtgtagaggtgaaattcgtagatattcggaagaacaccagtggcgaaggcggctcgctggacaagtattgacgctgaggtgcgaaagcgtggggagcaaacaggattagataccctggtagtccacgccgtaaacgatgataactagctgccggggcacatggtgtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcggatttcagagatgatttccttcagttcggctggatgagtgacaggtgctgcatggctgtcgtcagctcgtgtcgtgagatgttgggttaagtcccgcaacgagcgcaaccctcgcctttagttgccagcatttggttgggtactctaaaggaaccgccggtgataagccggaggaaggtggggatgacgtcaagtcctcatggcccttacgcgctgggctacacacgtgctacaatggcgactacagtgggctgcaaccgtgcgagcggtagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggatttggattcacccgaaggcactgcgttaacccgcaagggagacaggtgaccacggtgggtttagagactggggtgaagtcgtaacaaggtagccgtaggggaacctgcggctggatcacctcctttctaagga

SEQ ID NO: 8502 - DNA, 1497 bp, Sphingobium sp. HDIP04
  ref <308>: DATABASE ACCESSION NUMBER: NCBI ACCESSION: NZ_ATDO01000026.1
  ref <309>: DATABASE ENTRY DATE: 2019-04-01
  ref <313>: RELEVANT RESIDUES IN SEQ ID NO: (1)..(1497)
tcaaacttgagagtttgatcctggctcagaacgaacgctggcggcatgcctaatacatgcaagtcgaacgatcccttcggggatagtggcgcacgggtgcgtaacgcgtgggaatctgcccttgggttcggaataacgtctggaaacggacgctaataccggatgatgtcgataagaccaaagatttatcgcccagggatgagcccgcgtaggattagctagttggtggggtaaaggcccaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcaggggtgaaagcccggtgctcaacaccggaactgcccttgagactggattgcttgaatcacggagaggtgggtggaattccgagtgtagaggtgaaattcgtagatattcggaagaacaccagtggcgaaggcggcccactggacgtgtattgacgctgaggtgcgaaagcgtggggagcaaacaggattagataccctggtagtccacgccgtaaacgatgataactagctgctggggcgcatggcgtttcagtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggtttccagagatggataccttcagttcggctggataggtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcgactacagtgggcagccactccgcgaggaggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgcaaggaggcaggcgaccacagtgggtttagcgactggggtgaagtcgtaacaaggtagccgtaggggaacctgcggctggatcacctcctttctaagga

SEQ ID NO: 8503 - DNA, 1496 bp, Sphingobium sp. IP1
  ref <308>: DATABASE ACCESSION NUMBER: NCBI ACCESSION: NZ_NOIW01000185.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcctaatacatgcaagtcgaacgagatcttcggatctagtggcgcacgggtgcgtaacgcgtgggaatctgcccttgggttcggaataacttctggaaacggaagctaataccggatgatgacgtaagtccaaagatttatcgcccaaggatgagcccgcgtaggattagctagttggtgaggtaaaggctcaccaaggcgacgatccttagctggtctgagaggatgatcagccacactgggactgagacacggcccagactcctacgggaggcagcagtagggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctattcaagtcagaggtgaaagcccggggctcaaccccggaactgcctttgaaactagatagcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcagggcacatggtgttttggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggatcgtggagacactttccttcagttcggctggataggtgacaggtgctgcatggctgtcgtcagctcgtgtcgtgagatgttgggttaagtcccgcaacgagcgcaaccctcgcctttagttgccagcatttagttgggtactctaaaggaaccgccggtgataagccggaggaaggtggggatgacgtcaagtcctcatggcccttacgcgttgggctacacacgtgctacaatggcgactacagtgggcagccacctcgcgagagggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgtaaggaggcaggcgaccacagtgggtttagcgactggggtgaagtcgtaacaaggtagccgtaggggaacctgcggctggatcacctcctttctaagga

SEQ ID NO: 8504 - DNA, 1495 bp, Sphingobium sp. LB126
  ref <308>: DATABASE ACCESSION NUMBER: NCBI ACCESSION: NZ_NETV01000001.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaatacatgcaagtcgaacgatcccttcggggatagtggcgcacgggtgcgtaacgcgtgggaatctgcccttgggttcggaataacgtttggaaacgaacgctaataccggatgatgacgtaagtccaaagatttatcgcccaaggatgagcccgcgtaggattagctagttggtaaggtaaaggcttaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcaggggtgaaagcccagtgctcaacactggaactgcccttgagactggattgcttgaatcacggagaggtgggtggaattccgagtgtagaggtgaaattcgtagatattcggaagaacaccagtggcgaaggcggcccactggacgtgtattgacgctgaggtgcgaaagcgtggggagcaaacaggattagataccctggtagtccacgccgtaaacgatgataactagctgctggggtgcatggcatttcagtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggttaccagagatggtttccttcagttcggctggataggtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcgactacagtgggcagccactccgcgaggaggagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggattcactcgaaggcgttgagctaacccgcaagggaggcaggcgaccacagtgggtttagcgactggggtgaagtcgtaacaaggtagccgtaggggaacctgcggctggatcacctcctttctaag

SEQ ID NO: 8505 - DNA, 1493 bp, Sphingobium sp. LF-16
  ref <308>: DATABASE ACCESSION NUMBER: NCBI ACCESSION: NZ_CP029335.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaatacatgcaagtcgaacgagatcttcggatctagtggcgcacgggtgcgtaacgcgtgggaatctgcccttgggttcggaataacttctggaaacggaagctaataccggatgatgacgtaagtccaaagatttatcgcccaaggatgagcccgcgtaggattagctagttggtggggtaaaggcccaccaaggcgacgatccttagctggtctgagaggatgatcagccacactgggactgagacacggcccagactcctgcgggaggcagcagtagggaatattggacaatgggggaaaccctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctattcaagtcagaggtgaaagcccggggctcaaccccggaactgcctttgaaactagatagcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcagggcacatggtgttttggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggatcgtggagacactttccttcagttcggctggataggtgacaggtgctgcatggctgtcgtcagctcgtgtcgtgagatgttgggttaagtcccgcaacgagcgcaaccctcgcctttagttgccagcatttagttgggtactctaaaggaaccgccggtgataagccggaggaaggtggggatgacgtcaagtcctcatggcccttacgcgttgggctacacacgtgctacaatggcgactacagtgggcagccacctcgcgagagggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgtaaggaggcaggcgaccacagtgggtttagcgactggggtgaagtcgtaacaaggtagccgtaggggaacctgcggctggatcacctcctttctaag

SEQ ID NO: 8506 - DNA, 1496 bp, Sphingobium sp. Leaf26
  ref <308>: DATABASE ACCESSION NUMBER: NCBI ACCESSION: NZ_LMKV01000011.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcctaatacatgcaagtcgaacgagaccttcgggtctagtggcgcacgggtgcgtaacgcgtgggaatctgcccttgggttcggaataacagttggaaacgactgctaataccggatgatgacgtaagtccaaagatttatcgcccagggatgagcccgcgtaggattagctagttggtgaggtaaaggctcaccaaggcaacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgagatgataatgacagtatcgggagaataagctccggctaactccgtgccagcagccgcggtaatacggagggagctagcgttgttcggaattactgggcgtaaagcgcacgtaggcggcgatttaagtcagaggtgaaagcccggggctcaaccccggaactgcctttgagactggattgcttgaatcctggagaggtgagtggaattccgagtgtagaggtgaaattcgtagatattcggaagaacaccagtggcgaaggcggctcactggacaggtattgacgctgaggtgcgaaagcgtggggagcaaacaggattagataccctggtagtccacgccgtaaacgatgataactagctgccggggcacatggtgtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcggatcgtggagacactttccttcagttcggctggatgagtgacaggtgctgcatggctgtcgtcagctcgtgtcgtgagatgttgggttaagtcccgcaacgagcgcaaccctcgcctttagttgccagcatttggttgggtactctaaaggaaccgccggtgataagccggaggaaggtggggatgacgtcaagtcctcatggcccttacgcgctgggctacacacgtgctacaatggcgactacagtgggcagccacctcgcgagagggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgcaaggaggcaggcgaccacagtgggtttagcgactggggtgaagtcgtaacaaggtagccgtaggggaacctgcggctggatcacctcctttctaagga

SEQ ID NO: 8507 - DNA, 1496 bp, Sphingobium sp. MI1205
  ref <308>: DATABASE ACCESSION NUMBER: NCBI ACCESSION: NZ_CP005188.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcctaatacatgcaagtcgaacgagatcttcggatctagtggcgcacgggtgcgtaacgcgtgggaatctgcccttgggttcggaataacagttggaaacgactgctaataccggatgatgacgtaagtccaaagatttatcgcccaaggatgagcccgcgtaggattagctagttggtgaggtaaaggctcaccaaggctacgatccttagctggtctgagaggatgatcagccacactgggactgagacacggcccagactcctacgggaggcagcagtagggaatattggacaatgggcgaaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcagaggtgaaagcccggggctcaaccccggaacagcctttgagactggattgcttgaacatcggagaggtgagtggaattccgagtgtagaggtgaaattcgtagatattcggaagaacaccagtggcgaaggcggctcactggacgattgttgacgctgaggtgcgaaagcgtggggagcaaacaggattagataccctggtagtccacgccgtaaacgatgataactagctgctggggtgcatggcatttcagtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggatcgtggagacactttccttcagttcggctggataggtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcgactacagtgggcagccactccgcgaggaggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggtttcacccgaaggcagtgcgctaaccgcaaggaggcagctgaccacggtgggatcagcgactggggtgaagtcgtaacaaggtagccgtaggggaacctgcggctggatcacctcctttctaagga

SEQ ID NO: 8508 - DNA, 1496 bp, Sphingobium sp. Ndbn-10
  ref <308>: DATABASE ACCESSION NUMBER: NCBI ACCESSION: NZ_LFVX01000116.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcctaatacatgcaagtcgaacgagcctttcggggctagtggcgcacgggtgcgtaacgcgtgggaatctgcccttgggttcggaataacgtctggaaacggacgctaataccggatgatgacgaaagtccaaagatttatcgcccagggatgagcccgcgtaggattagctagttggtgaggtaaaggctcaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcagaggtgaaagcccggggctcaaccccggaatagcctttgagactggattgcttgaacatcggagaggtgagtggaattccgagtgtagaggtgaaattcgtagatattcggaagaacaccagtggcgaaggcggctcactggacgattgttgacgctgaggtgcgaaagcgtggggagcaaacaggattagataccctggtagtccacgccgtaaacgatgataactagctgctggggctcatggagtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatcctcatcgcgatttccagagatggatttcttcagttcggctggatgagtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcgactacagtgggcagcgaccatgcgagtggaagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgcgctaaccgcaaggaggcagctgaccacggtgggatcagcgactggggtgaagtcgtaacaaggtagccgtaggggaacctgcggctggatcacctcctttctaagga

SEQ ID NO: 8509 - DNA, 1498 bp, Sphingobium sp. RAC03
  ref <308>: DATABASE ACCESSION NUMBER: NCBI ACCESSION: NZ_CP016456.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaatacatgcaagtcgaacgatcctttcggggatagtggcgcacgggtgcgtaacgcgtgggaatctgcccttgggttcggaataacttcgggaaactgaagctaataccggatgatgacgaaagtccaaagatttatcgcccagggatgagcccgcgtaggattagctagttggtggggtaaaggcctaccaaggcgacgatccttagctggtctgagaggatgatcagccacactgggactgagacacggcccagactcctacgggaggcagcagtagggaatattggacaatgggcgaaagcctgatccagcaatgccgcgtgagtgatgaaggccttagggttgtaaagctcttttacccgagatgataatgacagtatcgggagaataagctccggctaactccgtgccagcagccgcggtaatacggagggagctagcgttgttcggaattactgggcgtaaagcgcacgtaggcggcgatttaagtcagaggtgaaagcccggggctcaaccccggaactgcctttgagactggattgctagaatcttggagaggcgagtggaattccgagtgtagaggtgaaattcgtagatattcggaagaacaccagtggcgaaggcggctcgctggacaagtattgacgctgaggtgcgaaagcgtggggagcaaacaggattagataccctggtagtccacgccgtaaacgatgataactagctgctggggcacatggtgtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcggatttcagagatgatttccttcagttcggctggatgagtgacaggtgctgcatggctgtcgtcagctcgtgtcgtgagatgttgggttaagtcccgcaacgagcgcaaccctcgcctttagttgccagcattcagttgggtactctaaaggaaccgccggtgataagccggaggaaggtggggatgacgtcaagtcctcatggcccttacgcgctgggctacacacgtgctacaatggcgactacagtgggctgcaaccgtgcgagcggtagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggatttggattcacccgaaggcactgcgctaactcgcaagagaggcaggtgaccacggtgggtttagagactggggtgaagtcgtaacaaggtagccgtaggggaacctgcggctggatcacctcctttctaagga

SEQ ID NO: 8510 - DNA, 1493 bp, Sphingobium sp. SA916
  ref <308>: DATABASE ACCESSION NUMBER: NCBI ACCESSION: NZ_LXYF01000099.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaatacatgcaagtcgaacgagcccttcggggttagtggcgcacgggtgcgtaacgcgtgggaatctgcccttgggttcggaataacgtctggaaacggacgctaataccggatgatgacgaaagtccaaagatttatcgcccagggatgagcccgcgtaggattagctagttggtgaggtaaaggctcaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcagaggtgaaagcccggggctcaaccccggaatagcctttgagactggattgcttgaacatcggagaggtgagtggaattccgagtgtagaggtgaaattcgtagatattcggaagaacaccagtggcgaaggcggctcactggacgattgttgacgctgaggtgcgaaagcgtggggagcaaacaggattagataccctggtagtccacgccgtaaacgatgataactagctgctggggctcatggagtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatcctcatcgcgatttccagagatggatttcttcagttcggctggatgagtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcgactacagtgggcagcgaccatgcgagtggaagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgcgctaaccgcaaggaggcagctgaccacggtgggatcagcgactggggtgaagtcgtaacaaggtagccgtaggggaacctgcggctggatcacctcctttctaag

SEQ ID NO: 8511 - DNA, 1495 bp, Sphingobium sp. SCG-1
  ref <308>: DATABASE ACCESSION NUMBER: NCBI ACCESSION: NZ_CP026372.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgagaccttcgggtctagtggcgcacgggtgcgtaacgcgtgggaatctgcccttgggttcggaataacagttggaaacgactgctaataccggatgatgacgtaagtccaaagatttatcgcccagggatgagcccgcgtaggattagctagttggtgaggtaaaggctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggcgatctaagtcagaggtgaaagcccggggctcaaccccggaatagcctttgagactggattgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgctggggctcatggagcttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcgttttccagagatggattacttcagttcggctggatgagtgacaggtgctgcatggctgtcgtcagctcgtgtcgtgagatgttgggttaagtcccgcaacgagcgcaaccctcgcctttagttgccagcatttagttgggtactctaaaggaaccgccggtgataagccggaggaaggtggggatgacgtcaagtcctcatggcccttacacgctgggctacacacgtgctacaatggcgactacagtgggcagcgacctcgcgaggggaagctaatctccaaaagtcgtctcagttcggattgttctctgcaactcgagagcatgaaggcggaatcgctagtaatcgcggatcagcacgccgcggtgaatacgttcccaggccttgtacacaccgcccgtcacaccatgggagttggattcacccgaaggcgttgcgctaacccgtaagggaggcaggcgaccacggtgggtttagcgactggggtgaagtcgtaacaaggtagccgtaggggaacctgcggctggatcacctcctttctaag

SEQ ID NO: 8512 - DNA, 1496 bp, Sphingobium sp. SYK-6
  ref <308>: DATABASE ACCESSION NUMBER: NCBI ACCESSION: NC_015976.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcctaatacatgcaagtcgaacgagatcttcggatctagtggcgcacgggtgcgtaacgcgtgggaatctgcccttgggttcggaataacagttagaaatgactgctaataccggatgatgacgtaagtccaaagatttatcgcccagggatgagcccgcgtaggattagctagttggtgaggtaaaggctcaccaaggcgacgatccttagctggtctgagaggatgatcagccacactgggactgagacacggcccagactcctacgggaggcagcagtagggaatattggacaatgggcgaaagcctgatccagcaatgccgcgtgagcgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggctatttaagtcaggggtgaaagcccggagctcaactccggaactgcctttgagactggatagctagaatcttggagaggcgagtggaattccgagtgtagaggtgaaattcgtagatattcggaagaacaccagtggcgaaggcggctcgctggacaagtattgacgctgaggtgcgaaagcgtggggagcaaacaggattagataccctggtagtccacgccgtaaacgatgataactagctgtccgggttcatggaattcgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggttagtggagacactttccttcagttcggctggataggtgacaggtgctgcatggctgtcgtcagctcgtgtcgtgagatgttgggttaagtcccgcaacgagcgcaaccctcgcctttagttgccagcatttagttgggtactctaaaggaaccgccggtgataagccggaggaaggtggggatgacgtcaagtcctcatggcccttacgcgttgggctacacacgtgctacaatggcgactacagtgggcagctatcccgcgagggtgagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgcgctaaccgcaaggaggcagctgaccacggtgggatcagcgactggggtgaagtcgtaacaaggtagccgtaggggaacctgcggctggatcacctcctttctaagga

SEQ ID NO: 8513 - DNA, 1498 bp, Sphingobium sp. TCM1
  ref <308>: DATABASE ACCESSION NUMBER: NCBI ACCESSION: NZ_LXVX01000033.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaatacatgcaagtcgaacgagatcttcggatctagtggcgcacgggtgcgtaacgcgtgggaatctgcccttgggttcggaataacagttggaaacgactgctaataccggatgatgacgaaagtccaaagatttatcgcccaaggatgagcccgcgtaggattagctagttggtggggtaaaggcctaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcagaggtgaaagcccggggctcaaccccggaactgcctttgagactggattgcttgaatccgggagaggtgagtggaattccgagtgtagaggtgaaattcgtagatattcggaagaacaccagtggcgaaggcggctcactggaccggcattgacgctgaggtgcgaaagcgtggggagcaaacaggattagataccctggtagtccacgccgtaaacgatgataactagctgccggggcacatggtgtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatcctcatcgcgatttccagagatggatttcttcagttcggctggatgagtgacaggtgctgcatggctgtcgtcagctcgtgtcgtgagatgttgggttaagtcccgcaacgagcgcaaccctcgcctttagttgccagcatttagttgggtactctaaaggaaccgccggtgataagccggaggaaggtggggatgacgtcaagtcctcatggcccttacgcgttgggctacacacgtgctacaatggcgactacagtgggcagcgacctcgcgaggggaagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaacccgcaagggaggcaggcgaccacagtgggtttagcgactggggtgaagtcgtaacaaggtagccgtaggggaacctgcggctggatcacctcctttctaagga

SEQ ID NO: 8514 - DNA, 1498 bp, Sphingobium sp. TKS
  ref <308>: DATABASE ACCESSION NUMBER: NCBI ACCESSION: NZ_CP005084.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaatacatgcaagtcgaacgagatccttcggggtctagtggcgcacgggtgcgtaacgcgtgggaatctgcccttgggttcggaataacgtttggaaacgaacgctaataccggatgatgacgaaagtccaaagatttatcgcccagggatgagcccgcgtaggattagctagttggtgaggtaaaggctcaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcaggggtgaaagcccagtgctcaacactggaactgcctttgagactggattgcttgaatcacggagaggtgggtggaattccgagtgtagaggtgaaattcgtagatattcggaagaacaccagtggcgaaggcggcccactggacgtgtattgacgctgaggtgcgaaagcgtggggagcaaacaggattagataccctggtagtccacgccgtaaacgatgataactagctgctggggtgcatggcatttcagtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggatcgtggagacactttccttcagttcggctggataggtgacaggtgctgcatggctgtcgtcagctcgtgtcgtgagatgttgggttaagtcccgcaacgagcgcaaccctcgactttagttgccatcatttagttgggtactctaaagtaaccgccggtgataagccggaggaaggtggggatgacgtcaagtcctcatggcccttacgcgttgggctacacacgtgctacaatggcgactacagtgggcagccactccgcgaggaggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgcaaggaggcaggcgaccacagtgggtttagcgactggggtgaagtcgtaacaaggtagccgtaggggaacctgcggctggatcacctcctttctaagga

SEQ ID NO: 8515 - DNA, 1497 bp, Sphingobium sp. TLA-22
  ref <308>: DATABASE ACCESSION NUMBER: NCBI ACCESSION: NZ_RZUL01000025.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgagtgccttcgggtgctagtggcgcacgggtgcgtaacgcgtgggaatctacccttgggttcggaataacagttggaaacgactgctaataccggatgatgacgtaagtccaaagatttatcgcccagggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggttatttaagtcagaggtgaaagcccagtgctcaacactggaactgcctttgagactggataacttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgctggggcacatggtgtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcgttttccagagatggattacttcagttcggctggatgagtgacaggtgctgcatggctgtcgtcagctcgtgtcgtgagatgttgggttaagtcccgcaacgagcgcaaccctcgcctttagttgccagcatttggttgggtactctaaaggaaccgccggtgataagccggaggaaggtggggatgacgtcaagtcctcatggcccttacacgctgggctacacacgtgctacaatggcgactacagtgggcagcaactccgcgaggggaagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcacccgaaggcgttgcgctaacccgtaagggaggcaggcgaccacggtgggtttagcgactggggtgaagtcgtaacaaggtagccgtaggggaacctgcggctggatcacctcctttctaag

SEQ ID NO: 8516 - DNA, 1496 bp, Sphingobium sp. YBL2
  ref <308>: DATABASE ACCESSION NUMBER: NCBI ACCESSION: NZ_CP010954.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcctaatacatgcaagtcgaacgagcccttcggggttagtggcgcacgggtgcgtaacgcgtgggaatctgcccttgggttcggaataacgtctggaaacggacgctaataccggatgatgacgaaagtccaaagatttatcgcccagggatgagcccgcgtaggattagctagttggtgaggtaaaggctcaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcagaggtgaaagcccggggctcaaccccggaatagcctttgagactggattgcttgaacatcggagaggtgagtggaattccgagtgtagaggtgaaattcgtagatattcggaagaacaccagtggcgaaggcggctcactggacgattgttgacgctgaggtgcgaaagcgtggggagcaaacaggattagataccctggtagtccacgccgtaaacgatgataactagctgctggggctcatggagtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatcctcatcgcgatttccagagatggatttcttcagttcggctggatgagtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcgactacagtgggcagcgaccatgcgagtggaagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgcgctaaccgcaaggaggcagctgaccacggtgggatcagcgactggggtgaagtcgtaacaaggtagccgtaggggaacctgcggctggatcacctcctttctaagga

SEQ ID NO: 8517 - DNA, 1493 bp, Sphingobium sp. YG1
  ref <308>: DATABASE ACCESSION NUMBER: NCBI ACCESSION: NZ_AP018518.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaatacatgcaagtcgaacgagatcttcggatctagtggcgcacgggtgcgtaacgcgtgggaatctgcccttgggttcggaataacgtcgggaaactgacgctaataccggatgatgacgaaagtccaaagatttatcgcccagggatgagcccgcgtaggattagctagttggtgaggtaaaggctcaccaaggctacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgagatgataatgacagtatcgggagaataagctccggctaactccgtgccagcagccgcggtaatacggagggagctagcgttgttcggaattactgggcgtaaagcgcacgtaggcggcgatttaagtcagaggtgaaagcccggggctcaaccccggaactgcctttgagactggattgcttgaatcctggagaggtgagtggaattccgagtgtagaggtgaaattcgtagatattcggaagaacaccagtggcgaaggcggctcactggacaggtattgacgctgaggtgcgaaagcgtggggagcaaacaggattagataccctggtagtccacgccgtaaacgatgataactagctgccggggcacatggtgtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggatcgtggagacactttccttcagttcggctggataggtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcgactacagtgggcagccacctcgcgagagggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgcaaggaggcaggcgaccacagtgggtttagcgactggggtgaagtcgtaacaaggtagccgtaggggaacctgcggctggatcacctcctttctaag

SEQ ID NO: 8518 - DNA, 1496 bp, Sphingobium sp. YL23
  ref <308>: DATABASE ACCESSION NUMBER: NCBI ACCESSION: NZ_ASTG01000050.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcctaatacatgcaagtcgaacgagcccttcggggttagtggcgcacgggtgcgtaacgcgtgggaatctgcccttgggttcggaataacgtcgggaaactgacgctaataccggatgatgacgtaagtccaaagatttatcgcccagggatgagcccgcgtaggattagctagttggtggggtaaaggctcaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcaggggtgaaagcccagtgctcaacactggaactgcccttgagactggattgcttgaatcacggagaggtgggtggaattccgagtgtagaggtgaaattcgtagatattcggaagaacaccagtggcgaaggcggcccactggacgtgtattgacgctgaggtgcgaaagcgtggggagcaaacaggattagataccctggtagtccacgccgtaaacgatgataactagctgctggggtgcatggcatttcagtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctagtgtggatcgtggagacactttccttcagttcggctggctaggtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcgactacagtgggcagcgaccatgcgagtggaagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggctgtgcgctaaccgcaaggaggcagcagaccacggtgggatcagcgactggggtgaagtcgtaacaaggtagccgtaggggaacctgcggctggatcacctcctttctaagga

SEQ ID NO: 8519 - DNA, 1496 bp, Sphingobium sp. YR657; identical to SEQ ID NO: 8503
  ref <308>: DATABASE ACCESSION NUMBER: NCBI ACCESSION: NZ_FRCG01000028.1
  ref <309>: DATABASE ENTRY DATE: 2019-04-01
  ref <313>: RELEVANT RESIDUES IN SEQ ID NO: (1)..(1496)

SEQ ID NO: 8520 - DNA, 1498 bp, Sphingobium sp. ba1; identical to SEQ ID NO: 8509
  ref <308>: DATABASE ACCESSION NUMBER: NCBI ACCESSION: NZ_JPPQ01000032.1
  ref <309>: DATABASE ENTRY DATE: 2019-04-01
  ref <313>: RELEVANT RESIDUES IN SEQ ID NO: (1)..(1498)

SEQ ID NO: 8521 - DNA, 1498 bp, Sphingobium ummariense
  ref <308>: DATABASE ACCESSION NUMBER: NCBI ACCESSION: NZ_AUWY01000047.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaatacatgcaagtcgaacgaaggcttcggccttagtggcgcacgggtgcgtaacgcgtgggaatctgcccttgggttcggaataacgtctggaaacggacgctaataccggatgatgacgtaagtccaaagatttatcgcccagggatgagcccgcgtaggattagctagttggtgaggtaaaggctcaccaaggcgacgatccttagctggtctgagaggatgatcagccacactgggactgagacacggcccagactcctacgggaggcagcagtagggaatattggacaatgggcgaaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggcgatttaagtcagaggtgaaagcccggggctcaaccccggaatagcctttgagactggattgcttgaatccgggagaggtgagtggaattccgagtgtagaggtgaaattcgtagatattcggaagaacaccagtggcgaaggcggctcactggaccggcattgacgctgaggtgcgaaagcgtggggagcaaacaggattagataccctggtagtccacgccgtaaacgatgataactagctgctggggctcatggagtttcagtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctagtatggttaccagagatggtttccttcagttcggctggctaggtgacaggtgctgcatggctgtcgtcagctcgtgtcgtgagatgttgggttaagtcccgcaacgagcgcaaccctcgcctttagttgccatcattcagttgggtactctaaaggaaccgccggtgataagccggaggaaggtggggatgacgtcaagtcctcatggcccttacgcgttgggctacacacgtgctacaatggcgactacagtgggcagctatctcgcgagagtgcgctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggtttcacccgaaggcgctgcgctaactcgcaagagaggcaggcgaccacggtgggatcagcgactggggtgaagtcgtaacaaggtagccgtaggggaacctgcggctggatcacctcctttctaagga

SEQ ID NO: 8522 - DNA, 1498 bp, Sphingobium xenophagum; identical to SEQ ID NO: 8501
  ref <308>: DATABASE ACCESSION NUMBER: NCBI ACCESSION: NZ_BARE01000094.1
  ref <309>: DATABASE ENTRY DATE: 2019-04-01
  ref <313>: RELEVANT RESIDUES IN SEQ ID NO: (1)..(1498)

SEQ ID NO: 8523 - DNA, 1493 bp, Sphingobium yanoikuyae
  ref <308>: DATABASE ACCESSION NUMBER: NCBI ACCESSION: NZ_QRAL01000084.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaatacatgcaagtcgaacgagatcttcggatctagtggcgcacgggtgcgtaacgcgtgggaatctgcccttgggttcggaataacttctggaaacggaagctaataccggatgatgacgtaagtccaaagatttatcgcccaaggatgagcccgcgtaggattagctagttggtggggtaaaggcccaccaaggcgacgatccttagctggtctgagaggatgatcagccacactgggactgagacacggcccagactcctacgggaggcagcagtagggaatattggacaatgggggaaaccctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctattcaagtcagaggtgaaagcccggggctcaaccccggaactgcctttgaaactagatagcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcagggcacatggtgttttggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggatcgtggagacactttccttcagttcggctggataggtgacaggtgctgcatggctgtcgtcagctcgtgtcgtgagatgttgggttaagtcccgcaacgagcgcaaccctcgcctttagttgccagcatttagttgggtactctaaaggaaccgccggtgataagccggaggaaggtggggatgacgtcaagtcctcatggcccttacgcgttgggctacacacgtgctacaatggcgactacagtgggcagccacctcgcgagagggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgtaaggaggcaggcgaccacagtgggtttagcgactggggtgaagtcgtaacaaggtagccgtaggggaacctgcggctggatcacctcctttctaag

SEQ ID NO: 8524 - DNA, 1495 bp, Sphingomonadaceae bacterium
  ref <308>: DATABASE ACCESSION NUMBER: NCBI ACCESSION: NZ_QFZL01000009.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgagatcttcggatctagtggcgcacgggtgcgtaacgcgtgggaatctgccctggggtgcggaataactcggagaaattcgtgctaataccgcataatgtcgtaagaccaaagatttatcgccctgggatgagcccgcgtaggattagctagttggtgaggtaaaagctcaccaaggcgacgatccttagctggtctgagaggatgatcagccacactgggactgagacacggcccagactcctacgggaggcagcagtggggaatattggacaatgggggaaaccctgatccagcaatgccgcgtgagtgatgaaggccctagggttgtaaagctcttttacccgagatgataatgacagtatcgggagaataagctccggctaactccgtgccagcagccgcggtaatacggagggagctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagtgtggggagcaaacaggattagataccctggtagtccacaccgtaaacgatgataactagctgtcagggcacttggtgctttggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatggtaggacgacttccagagatggatttcttcccttcggggacctacacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgttgggctacacacgtgctacaatggcaggtacagtgggcagcaatcccgcgagggtgagctaatctccaaaacctgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggtggtgcgctaaccagtttactggaggcagccaaccacggtgggttcagcgactggggtgaagtcgtaacaaggtagccgtaggggaacctgcggctggatcacctcctttctaag

SEQ ID NO: 8525 - DNA, 1493 bp, Sphingomonadaceae bacterium KCTC 52944
  ref <308>: DATABASE ACCESSION NUMBER: NCBI ACCESSION: NZ_RAGX01000003.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaacacatgcaagtcgaacgagaccttcgggtctagtggcgcacgggtgcgtaacgcgtgggaatctacccttgggttcggaataacagttagaaatgactgctaataccggatgatgacgaaagtccaaagatttatcgcccatggatgagcccgcgtaagattagcttgttggtggggtaatggcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaatcactgggcgtaaagcgtgcgtaggcggtgactcaagtcagaggtgaaagcctggagctcaactccagaactgcctttgaaactaggtcgctagaacatcggagaggtgagtggaattccgagtgtagaggtgaaattcgtagatattcggaagaacaccagtggcgaaggcggctcactggacgattgttgacgctgaggcacgaaagcgtggggagcaaacaggattagataccctggtagtccacgccgtaaacgatgataactagctgccggggcacttggtgcttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggatagtggagacactttccttcagttcggctggatcagtgacaggtgctgcatggctgtcgtcagctcgtgtcgtgagatgttgggttaagtcccgcaacgagcgcaaccctcgtccttagttgccagcattcagttgggcactctaaggaaaccgccggtgataagccggaggaaggtggggatgacgtcaagtcctcatggcccttacgcgctgggctacacacgtgctacaatggcgactacagtgggcagccacctcgcaagggggagctaatctcaaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttcta

SEQ ID NO: 8526 - DNA, 1498 bp, Sphingomonadales bacterium EhC05
  ref <308>: DATABASE ACCESSION NUMBER: NCBI ACCESSION: NZ_LXYP01000017.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcttaacacatgcaagtcgaacgagatcttcggatctagtggcgcacgggtgcgtaacgcgtggggatctaccaaggggtgcggaataactcagagaaatttgtgctaataccgcataatgtcgcaagaccaaagatttatcgccctttgatgaacccgcgtaagattagcttgttggtgaggtaaaggctcaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttactagggatgataatgacagtacctagagaataagctccggctaactccgtgccagcagccgcggtaatacggagggagctagcgttgttcggaattactgggcgtaaagcgcgcgtaggcggttattcaagtcagaggtgaaagcccggagctcaactccggaactgcctttgaaactagatagctagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgctagggcccacagggctttggtggcgcagctaacgcattaagttatccgcctggggagtacggtcgcaagattaaaactcaaaggaattgacgggggcctgcacaagcggtggagcatgtggtttaattcgacgcaacgcgcagaaccttaccagcgtttgacatccttatcgcggatttgagagatcatttccttcagctcggctggataagtgacaggtgctgcatggctgtcgtcagctcgtgtcgtgagatgttgggttaagtcccgcaacgagcgcaacccctatctttagttgctaccatttagttgggcactctaaagagaccgccggtgataagccggaggaaggtggggatgacgtcaagtcctcatggcccttacacgctgggctacacacgtgctacaatggcggtgacagtgggcagctacttcgcgagaagatgctaatctctaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggatcaacccgaagctagtgcgctaactcgcaagagaggcagctaaccacggtgggttcagcgactggggtgaagtcgtaacaaggtagccgtaggggaacctgcggctggatcacctcctttctaagga

SEQ ID NO: 8527 - DNA, 1492 bp, Sphingomonas aerolata
  ref <308>: DATABASE ACCESSION NUMBER: NCBI ACCESSION: NZ_PZZN01000005.1
  ref <309>: DATABASE ENTRY DATE: 2019-04-01
  ref <313>: RELEVANT RESIDUES IN SEQ ID NO: (1)..(1492)
aaacttgagagtttgatcatggctcagaatgaacgctggcggcatgcctaacacatgcaagtcgaacgaagccttcgggtttagtggcgcacgggtgcgtaacgcgtgggaatctgccccttggttcggaataacagttggaaacgactgctaataccggatgatgacgtaagtccaaagatttatcgccgagggatgagcccgcgtaggattaggtagttggtgtggtaaaggcgcaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggcaggacgacttctggagacagatttcttcccttcggggacctgcacacaggtgctgcatggctgtcgtcagctcgtgtcgtgagatgttgggttaagtcccgcaacgagcgcaaccctcgaccttagttgccatcatttagttgggcactttaaggtaaccgccggtgataagccggaggaaggtggggatgacgtcaagtcctcatggcccttacgcgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaactcgcaagagaggcaggcgaccacggtgggtttagcgactggggtgaagtcgtaacaaggtagccgtaggggaacctgcggctggatcacctcctttctaag

SEQ ID NO: 8528 - DNA, 1494 bp, Sphingomonas asaccharolytica
  ref <308>: DATABASE ACCESSION NUMBER: NCBI ACCESSION: NZ_BCYU01000001.1
  ref <309>: DATABASE ENTRY DATE: 2019-04-01
  ref <313>: RELEVANT RESIDUES IN SEQ ID NO: (1)..(1494)
aaacttgagagtttgatcatggctcagaatgaacgctggcggcatgcctaacacatgcaagtcgaacgagaccttcgggtctagtggcgcacgggtgcgtaacgcgtgggaatctgcccttgggttcggaataacagtgagaaattactgctaataccgaatgatgacgtaagtccaaagatttatcgcccagggatgagcccgcgtaggattagctagttggtgaggtaaaagctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacttagtgcttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcgactacagtgggcagcaatcccgcgagggtgagctaatctccaaaagtcgtctcagttcggattgcactctgcaactcgagtgcatgaaggcggaatcgctagtaatcgcggatcagcatgccgcggtgaatacgttcccaggccttgtacacaccgcccgtcacaccatgggagttggattcacccgaaggcgttgcgctaactcgcaagagaggcaggcgaccacggtgggtttagcgactggggtgaagtcgtaacaaggtagccgtaggggaacctgcggctggatcacctcctttctaagga

SEQ ID NO: 8529 - DNA, 1497 bp, Sphingomonas astaxanthinifaciens
  ref <308>: DATABASE ACCESSION NUMBER: NCBI ACCESSION: NZ_JONN01000001.1
  ref <309>: DATABASE ENTRY DATE: 2019-04-01
  ref <313>: RELEVANT RESIDUES IN SEQ ID NO: (1)..(1497)
ttcaacttgagagtttgattctggctcagaacgaacgctggcggcatgcctaacacatgcaagtcgaacgaagccttcgggcttagtggcgcacgggtgcgtaacgcgtgggaatctgcccttgggttcggaataacagttagaaatgactgctaataccggatgatgtcttcggaccaaagatttatcgcccagggatgagcccgcgtcggattagctagttggtgaggtaaaggctcaccaaggcgacgatccgtagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggctttgtaagttagaggtgaaagcccggagctcaactccggaactgcctttaagactgcatcgctagaatcatggagaggtcagtggaattccgagtgtagaggtgaaattcgtagatattcggaagaacaccagtggcgaaggcgactgactggacatgtattgacgctgaggtgcgaaagcgtggggagcaaacaggattagataccctggtagtccacgccgtaaacgatgataactagctgtcagggctcttggagttttggtggcgcagctaacgcgttaagttatccgcctggggagtacggccgcaaggttaaaactcaaagaaattgacgggggcctgcacaagcggtggagcatgtggtttaattcgaagcaacgcgcagaaccttaccagcgtttgacatggtaggacggttactggagacagtttccttcccttacgggacctacacacaggtgctgcatggctgtcgtcagctcgtgtcgtgagatgttgggttaagtcccgcaacgagcgcaaccctcgtctttagttgccatcattcagttgggcactctaaagaaactgccggtgataagccggaggaaggtggggatgacgtcaagtcctcatggcccttacgcgctgggctacacacgtgctacaatggcggtgacagtgggaagcaaactcgcgagggtgagctaatccccaaaagccgtctcagttcggattgttctctgcaactcgagagcatgaaggcggaatcgctagtaatcgtggatcagcatgccacggtgaatacgttcccaggccttgtacacaccgcccgtcacaccatgggagttggtttcacccgaaggcgctgcgctaacccgcaagggaggcaggcgaccacggtgggatcagcgactggggtgaagtcgtaacaaggtagccgtaggggaacctgcggctggatcacctcctttctaaggaa

SEQ ID NO: 8530 - DNA, 1492 bp, Sphingomonas aurantiaca
  ref <308>: DATABASE ACCESSION NUMBER: NCBI ACCESSION: NZ_QAOG01000012.1
  ref <309>: DATABASE ENTRY DATE: 2019-04-01
  ref <313>: RELEVANT RESIDUES IN SEQ ID NO: (1)..(1492)
aaacttgagagtttgatcatggctcagaatgaacgctggcggcatgcctaacacatgcaagtcgaacgaaggcttcggccttagtggcgcacgggtgcgtaacgcgtgggaatctgccccttggttcggaataacagttggaaacgactgctaataccggatgatgacgtaagtccaaagatttatcgccgagggatgagcccgcgtaggattaggtagttggtgtggtaaaggcgcaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggcaggacgacttccggagacggatttcttcccttcggggacctgcacacaggtgctgcatggctgtcgtcagctcgtgtcgtgagatgttgggttaagtcccgcaacgagcgcaaccctcgcctttagttgccatcatttagttgggcactttaaaggaaccgccggtgataagccggaggaaggtggggatgacgtcaagtcctcatggcccttacgcgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaactcgtaagagaggcaggcgaccacggtgggtttagcgactggggtgaagtcgtaacaaggtagccgtaggggaacctgcggctggatcacctcctttctaag

SEQ ID NO: 8531 - DNA, 1498 bp, Sphingomonas azotifigens
  ref <308>: DATABASE ACCESSION NUMBER: NCBI ACCESSION: NZ_BCTR01000108.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgagatccttcggggtctagtggcgcacgggtgcgtaacgcgtgggaatctgccttggggttcggaataactccccgaaaggggtgctaataccggatgatgtcgaaagaccaaagatttatcgccctgagatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatggtaggacgactggcagagatgcctttcttcccttcggggacctacacacaggtgctgcatggctgtcgtcagctcgtgtcgtgagatgttgggttaagtcccgcaacgagcgcaaccctcgactttagttaccatcattaagttgggtactttaaagtaaccgccggtgataagccggaggaaggtggggatgacgtcaagtcctcatggcccttacgcgctgggctacacacgtgctacaatggcaagtacagtgggcagcaatcccgcgagggtgagctaatctccaaaacttgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgtaagagaggcaggcgaccacggtgggcttagcgactggggtgaagtcgtaacaaggtagccgtaggggaacctgcggctggatcacctcctttctaagga

SEQ ID NO: 8532 - DNA, 1494 bp, Sphingomonas changbaiensis
  ref <308>: DATABASE ACCESSION NUMBER: NCBI ACCESSION: NZ_BBWU01000045.1
  ref <309>: DATABASE ENTRY DATE: 2019-04-01
  ref <313>: RELEVANT RESIDUES IN SEQ ID NO: (1)..(1494)
tcaaacttgagagtttgatcctggctcagaacgaacgctggcggcatgcctaacacatgcaagtcgaacgagaccttcgggtctagtggcgcacgggtgcgtaacgcgtgggaatctgcccttgggttcggaataacttcgggaaactgaagctaataccggatgatgtcgtaagaccaaagatttatcgcccaaggatgagcccgcgtaggattagctagttggtgaggtaaaggctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggatgataatgacagtaccgggagaataagccccggctaactccgtgccagcagccgcggtaatacggagggggctagcgttgttcggaattactgggcgtaaagcgcacgtaggcggctttgtaagtcagaggtgaaagcccggagcttaactccggaattgcctttgagactgcatcgcttgaatccgggagaggtgagtggaattccgagtgtagaggtgaaattcgtagatattcggaagaacaccagtggcgaaggcggctcactggaccggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatggtaggacggtttctggagacagattccttcccttcggggacctacacacaggtgctgcatggctgtcgtcagctcgtgtcgtgagatgttgggttaagtcccgcaacgagcgcaaccctcgtccttagttgccatcatttagttgggtactctaaggaaaccgccggtgataagccggaggaaggtggggatgacgtcaagtcctcatggcccttacgcgctgggctacacacgtgctacaatggcggtgacaatgggcagcaatcccgcgagggtgagctaatctccaaaagccgtctcagttcggattgttctctgcaactcgagagcatgaaggcggaatcgctagtaatcgtggatcagcatgccacggtgaatacgttcccaggccttgtacacaccgcccgtcacaccatgggagttggattgacccgaagacagtgagctaaccgcaaggaggcagctggccacggtcggttcagcgactggggtgaagtcgtaacaaggtagccgtaggggaacctgcggctggatcacctcctttctaagga

SEQ ID NO: 8533 - DNA, 1494 bp, Sphingomonas crusticola
  ref <308>: DATABASE ACCESSION NUMBER: NCBI ACCESSION: NZ_QTJP01000001.1
  ref <309>: DATABASE ENTRY DATE: 2019-04-01
  ref <313>: RELEVANT RESIDUES IN SEQ ID NO: (1)..(1494)
aaacttgagagtttgattctggctcagaacgaacgctggcggcatgcctaacacatgcaagtcgaacgagaccttcgggtctagtggcgcacgggtgcgtaacgcgtgggaatctgccctttgctacggaataactcggggaaactcgtgctaataccgtatgatgtcgcaagaccaaagatttatcggcaaaggatgagcccgcgtaggattagcttgttggtgaggtaaaggctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagctccggctaactccgtgccagcagccgcggtaatacggagggagctagcgttgttcggaattactgggcgtaaagcgcacgtaggcggctttgtaagttagaggtgaaagcctggggctcaactccagaattgcctttaagactgcatcgcttgaatcatggagaggcgagtggaattccgagtgtagaggtgaaattcgtagatattcggaagaacaccagtggcgaaggcggctcgctggacatgtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaagaaattgacgggggcctgcacaagcggtggagcatgtggtttaattcgaagcaacgcgcagaaccttaccaacgtttgacatgtctagtatggttttcagagatgaattccttcagttcggctggctagaacacaggtgctgcatggctgtcgtcagctcgtgtcgtgagatgttgggttaagtcccgcaacgagcgcaaccctcgtctttagttgccatcattaagttgggcactctaaagaaaccgccggtgataagccggaggaaggtggggatgacgtcaagtcctcatggcccttacgcgttgggctacacacgtgctacaatggcggtgacaatgggccgcaaccctgcgaggggtagctaatcccaaaaagccgtctcagttcggattgcactctgcaactcgagtgcatgaaggcggaatcgctagtaatcgcggatcagcatgccgcggtgaatacgttcccaggccttgtacacaccgcccgtcacaccatgggagttggtttcacccgaaggcgctgcgctaactcgcaagagaggcaggcgaccacggtgggattagcgactggggtgaagtcgtaacaaggtagccgtaggggaacctgcggctggatcacctcctttctaag

SEQ ID NO: 8534 - DNA, 1493 bp, Sphingomonas desiccabilis
  ref <308>: DATABASE ACCESSION NUMBER: NCBI ACCESSION: NZ_SDPT01000005.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaacacatgcaagtcgaacgagaccttcgggtctagtggcgcacgggtgcgtaacgcgtgggaatctgcccttgggttcggaataacagttggaaacgactgctaataccggatgatgacgtaagtccaaagatttatcgcccagggatgagcccgcgtaggattagctagttggtggggtaaaggcctaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggctttgtaagttagaggtgaaagcctggagctcaactccagaattgcctttaagactgcatcgcttgaatccgggagaggtgagtggaattccgagtgtagaggtgaaattcgtagatattcggaagaacaccagtggcgaaggcggctcactggaccggcattgacgctgaggtgcgaaagcgtggggagcaaacaggattagataccctggtagtccacgccgtaaacgatgataactagctgtccgggtgcttggcatttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgtccggacgactggcagagatgcctttcttcccttcggggactggaacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcaactacagtgggcagcaatcccgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaaggggagcaggcgaccacggtgggttcagcgactggggtgaagtcgtaacaaggtagccgtaggggaacctgcggctggatcacctcctttctaag

SEQ ID NO: 8535 - DNA, 1493 bp, Sphingomonas echinoides
  ref <308>: DATABASE ACCESSION NUMBER: NCBI ACCESSION: NZ_JH584237.1
  ref <309>: DATABASE ENTRY DATE: 2019-04-01
  ref <313>: RELEVANT RESIDUES IN SEQ ID NO: (1)..(1493)
taaacttgagagtttgatcatggctcagaatgaacgctggcggcatgcctaacacatgcaagtcgaacgaaggctttggccttagtggcgcacgggtgcgtaacgcgtgggaatctgccctcaggttcggaataacagcgagaaattgctgctaataccggatgatatcgcgagatcaaagatttatcgcctgaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcggggctcttagagcttcggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttcgggagaccgatctcttcccttcggggactggaacacaggtgctgcatggctgtcgtcagctcgtgtcgtgagatgttgggttaagtcccgcaacgagcgcaaccctcgtccttagttgccatcattcagttgggcactctaaggaaaccgccggtgataagccggaggaaggtggggatgacgtcaagtcctcatggcccttacgcgctgggctacacacgtgctacaatggcggtgacagtgggcagcaatctcgcaagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcgtaacaaggtagccgtaggggaacctgcggctggatcacctcctttctaagga

SEQ ID NO: 8536 - DNA, 1493 bp, Sphingomonas elodea
  ref <308>: DATABASE ACCESSION NUMBER: NCBI ACCESSION: NZ_RBIU01000001.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaacacatgcaagtcgaacgagatcttcggatctagtggcgcacgggtgcgtaacgcgtgggaatctgccttggggttcggaataactccccgaaaggggtgctaataccggatgatgtcgaaagaccaaagatttatcgccctgagatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatggtaggacgactggcagagatgcctttcttcccttcggggacctacacacaggtgctgcatggctgtcgtcagctcgtgtcgtgagatgttgggttaagtcccgcaacgagcgcaaccctcgactttagttaccatcattaagttgggtactttaaagtaaccgccggtgataagccggaggaaggtggggatgacgtcaagtcctcatggcccttacgcgctgggctacacacgtgctacaatggcaagtacagtgggcagcaatcccgcgagggtgagctaatctccaaaacttgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaag

SEQ ID NO: 8537 - DNA, 1496 bp, Sphingomonas endophytica
  ref <308>: DATABASE ACCESSION NUMBER: NCBI ACCESSION: NZ_LDTB01000042.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcctaacacatgcaagtcgaacgatgctttcgggcatagtggcgcacgggtgcgtaacgcgtgggaatctgcccttgggtctgggataacttctggaaacggaagctaataccggatgatatcgcgagatcaaagatttatcgcccgaggatgagcccgcgtaggattagctagttggtggggtaaaggcctaccaaggcgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggctttgtaagtcaggggtgaaagcctggagctcaactccagaactgcctttgagactgcatcgcttgaatccgggagaggtaagtggaattccgagtgtagaggtgaaattcgtagatattcggaagaacaccagtggcgaaggcggcttactggaccgggattgacgctgaggtgcgaaagcgtggggagcaaacaggattagataccctggtagtccacgccgtaaacgatgataactagctgtccggggacctggtctttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgattcccagagatgggtctcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcgactacagtgggctgcaatcccgcgagggtgagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaacccgtaagggaggcaggcgaccacggtgggcttagcgactggggtgaagtcgtaacaaggtagccgtaggggaacctgcggctggatcacctcctttctaagga

SEQ ID NO: 8538 - DNA, 1492 bp, Sphingomonas faeni
  ref <308>: DATABASE ACCESSION NUMBER: NCBI ACCESSION: NZ_QAYE01000025.1
  ref <309>: DATABASE ENTRY DATE: 2019-04-01
  ref <313>: RELEVANT RESIDUES IN SEQ ID NO: (1)..(1492)
aaacttgagagtttgatcatggctcagaatgaacgctggcggcatgcctaacacatgcaagtcgaacgaaggcttcggccttagtggcgcacgggtgcgtaacgcgtgggaatctgccccttggttcggaataacagttggaaacgactgctaataccggatgatgacgtaagtccaaagatttatcgccgagggatgagcccgcgtaggattaggtagttggtgtggtaaaggcgcaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacaggattagataccctggtagtccacgccgtaaacgatgataactagctgtccggacacttggtgtttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggcaggacgacttccagagatggatttcttcccttcggggacctgcacacaggtgctgcatggctgtcgtcagctcgtgtcgtgagatgttgggttaagtcccgcaacgagcgcaaccctcgcctttagttgccatcatttagttgggcactttaaaggaaccgccggtgataagccggaggaaggtggggatgacgtcaagtcctcatggcccttacgcgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaactcgtaagagaggcaggcgaccacggtgggtttagcgactggggtgaagtcgtaacaaggtagccgtaggggaacctgcggctggatcacctcctttctaag

SEQ ID NO: 8539 - DNA, 1494 bp, Sphingomonas fennica
  ref <308>: DATABASE ACCESSION NUMBER: NCBI ACCESSION: NZ_PHHF01000058.1
  ref <309>: DATABASE ENTRY DATE: 2019-04-01
  ref <313>: RELEVANT RESIDUES IN SEQ ID NO: (1)..(1494)
caacttgagagtttgattctggctcagaacgaacgctggcggcatgcctaacacatgcaagtcgaacgaaggcttcggccttagtggcgcacgggtgcgtaacgcgtgggaatctgccctttggtacggaataacagtgagaaattactgctaataccgtatgatgtcgcgagaccaaagatttatcgccaaaggatgagcccgcgtaggattagctagttggtggggtaaaggcccaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggcttggtaagttagaggtgaaagcccggagctcaactccggaatagcctttaagactgcctcgcttgaacgtcggagaggtgagtggaattccgagtgtagaggtgaaattcgtagatattcggaagaacaccagtggcgaaggcggctcactggacgactgttgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaagaaattgacgggggcctgcacaagcggtggagcatgtggtttaattcgaagcaacgcgcagaaccttaccaacgtttgacatccctatcgcggttagtggagacactttccttcagttcggctggataggtgacaggtgctgcatggctgtcgtcagctcgtgtcgtgagatgttgggttaagtcccgcaacgagcgcaaccctcgcctttagttgccatcattaagttgggcactctaaaggaaccgccggtgataagccggaggaaggtggggatgacgtcaagtcctcatggcccttacgcgttgggctacacacgtgctacaatggcaactacagtgggcagcgaactcgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaacccgcaagggaggcaggcgaccacggtgggtttagcgactggggtgaagtcgtaacaaggtagccgtaggggaacctgcggctggatcacctcctttctaag

SEQ ID NO: 8540 - DNA, 1495 bp, Sphingomonas guangdongensis
  ref <308>: DATABASE ACCESSION NUMBER: NCBI ACCESSION: NZ_OBMI01000006.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacggatgctttcgggcattagtggcgcacgggtgcgtaacgcgtgggaatctgccctggggtctgggataacttctcgaaagggaagctaataccggatgatatcgcgagatcaaagatttatcgccctgggatgagcccgcgtccgattaggtagttggtggggtaaaggcctaccaagccgacgatcggtagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggctttgtaagttaggggtgaaagcctggtgctcaacaccagaactgcctttgatactgcatggcttgaatccgagagaggtgagtggaattccgagtgtagaggtgaaattcgtagatattcggaagaacaccagtggcgaaggcggctcactggctcggtattgacgctgaggtgcgaaagcgtggggagcaaacaggattagataccctggtagtccacgccgtaaacgatgataactagctgtcggggcacttggtgtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatggtaggacgactggcagagatgcctttcttcccttcggggacctacacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcaagtacagtgggcagcaatcccgcgagggtgagctaatctccaaaacttgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgtaagagaggcaggcgaccacggtgggcttagcgactggggtgaagtcgtaacaaggtagccgtaggggaacctgcggctggatcacctcctttctaag

SEQ ID NO: 8541 - DNA, 1497 bp, Sphingomonas haloaromaticamans
  ref <308>: DATABASE ACCESSION NUMBER: NCBI ACCESSION: NZ_MIPT01000001.1
  ref <309>: DATABASE ENTRY DATE: 2019-04-01
  ref <313>: RELEVANT RESIDUES IN SEQ ID NO: (1)..(1497)
tcaacttgagagtttgattctggctcagaacgaacgctggcggcatgcctaacacatgcaagtcgaacgaaggcttcggccttagtggcgcacgggtgcgtaacgcgtgggaatctgccctttggtacggaataacagtgagaaattactgctaataccgtatgatgtcgcgagaccaaagatttatcgccaaaggatgagcccgcgtaggattagctagttggtggggtaaaggcccaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggcttggtaagttagaggtgaaagcccggagctcaactccggaatagcctttaagactgcctcgcttgaacgtcggagaggtgagtggaattccgagtgtagaggtgaaattcgtagatattcggaagaacaccagtggcgaaggcggctcactggacgactgttgacgctgaggtgcgaaagcgtggggagcaaacaggattagataccctggtagtccacgccgtaaacgatgataactagctgtccgggcacttggtggttgggtggcgcagctaacgcattaagttatccgcctggggagtacggccgcaaggttaaaactcaaagaaattgacgggggcctgcacaagcggtggagcatgtggtttaattcgaagcaacgcgcagaaccttaccaacgtttgacatccctatcgcggttagtggagacactttccttcagttcggctggataggtgacaggtgctgcatggctgtcgtcagctcgtgtcgtgagatgttgggttaagtcccgcaacgagcgcaaccctcgcctttagttgccatcattaagttgggcactctaaaggaaccgccggtgataagccggaggaaggtggggatgacgtcaagtcctcatggcccttacgcgttgggctacacacgtgctacaatggcaactacagtgggcagcgaactcgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaacccgcaagggaggcaggcgaccacggtgggtttagcgactggggtgaagtcgtaacaaggtagccgtaggggaacctgcggctggatcacctcctttctaagga

SEQ ID NO: 8542 - DNA, 1498 bp, Sphingomonas hankookensis
  ref <308>: DATABASE ACCESSION NUMBER: NCBI ACCESSION: NZ_LQQO01000036.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgagatccttcggggtctagtggcgcacgggtgcgtaacgcgtgggaatctgcccttaggttcggaataacagttagaaatgactgctaataccggatgatgacgttaagtccaaagatttatcgcctgaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgtccggacgacttcgagagatcgatttcttcccttcggggactggaacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcaggtacagtgggcagcaatcccgcgagggtgagctaatctccaaaacctgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgtaagggaagcaggcgaccacggtgggttcagcgactggggtgaagtcgtaacaaggtagccgtaggggaacctgcggctggatcacctcctttctaagg

SEQ ID NO: 8543 - DNA, 1495 bp, Sphingomonas histidinilytica
  ref <308>: DATABASE ACCESSION NUMBER: NCBI ACCESSION: NZ_FUYM01000034.1
  ref <309>: DATABASE ENTRY DATE: 2019-04-01
  ref <313>: RELEVANT RESIDUES IN SEQ ID NO: (1)..(1495)
tcaacttgagagtttgattctggctcagaacgaacgctggcggcatgcctaacacatgcaagtcgaacgaaggcttcggccttagtggcgcacgggtgcgtaacgcgtgggaatctgcccttgggtacggaataactctccgaaaggagtgctaataccgtatgatgacgaaagtccaaagatttatcgcctgaggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagttagaggtgaaagcccggggctcaaccccggaattgcctttaagactgcatcgcttgaacgtcggagaggtgagtggaattccgagtgtagaggtgaaattcgtagatattcggaagaacaccagtggcgaaggcggctcactggacgactgttgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaagaaattgacgggggcctgcacaagcggtggagcatgtggtttaattcgaagcaacgcgcagaaccttaccaacgtttgacatccctagtatggttagtggagacactttccttcagttcggctggctaggtgacaggtgctgcatggctgtcgtcagctcgtgtcgtgagatgttgggttaagtcccgcaacgagcgcaaccctcgcctttagttgccatcattaagttgggtactctaaaggaaccgccggtgataagccggaggaaggtggggatgacgtcaagtcctcatggcccttacgcgttgggctacacacgtgctacaatggcaactacagtgggcagcaatcccgcgagggcgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaaccgcaaggaggcaggcgaccacggtgggtttagcgactggggtgaagtcgtaacaaggtagccgtaggggaacctgcggctggatcacctcctttctaagga

SEQ ID NO: 8544 - DNA, 1494 bp, Sphingomonas indica
  ref <308>: DATABASE ACCESSION NUMBER: NCBI ACCESSION: NZ_LT840185.1
  ref <309>: DATABASE ENTRY DATE: 2019-04-01
  ref <313>: RELEVANT RESIDUES IN SEQ ID NO: (1)..(1494)
aaacttgagagtttgattctggctcagaacgaacgctggcggcatgcctaacacatgcaagtcgaacgagaccttcgggtctagtggcgcacgggtgcgtaacgcgtgggaatctgcccttcggttcggaataacagttagaaatgactgctaataccggatgatgtcttcggaccaaagatttatcgccgagggatgagcccgcgtaggattagcttgttggtgaggtaaaggctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcgcgtaggcggctttgtaagttagaggtgaaagcctggagctcaactccagaactgcctttaagactgcatcgcttgaatccgggagaggtgagtggaattccgagtgtagaggtgaaattcgtagatattcggaagaacaccagtggcgaaggcggctcactggaccggcattgacgctgaggtgcgaaagcgtggggagcaaacaggattagataccctggtagtccacgccgtaaacgatgataactagctgtcgggggtcttagactttcggtggcgcagctaacgcattaagttatccgcctggggagtacggccgcaaggttaaaactcaaagaaattgacgggggcctgcacaagcggtggagcatgtggtttaattcgaagcaacgcgcagaaccttaccaacgtttgacatgtccagtatggttagtggagacactttccttcagttcggctggctggaacacaggtgctgcatggctgtcgtcagctcgtgtcgtgagatgttgggttaagtcccgcaacgagcgcaaccctcgaccttagttgccatcattaagttgggcactctaaggtaaccgccggtgataagccggaggaaggtggggatgacgtcaagtcctcatggcccttacgcgttgggctacacacgtgctacaatggcgactacagtgggcagcaaactcgcgagggtgagctaatctccaaaagtcgtctcagttcggattgcactctgcaactcgagtgcatgaaggcggaatcgctagtaatcgcggatcagcatgccgcggtgaatacgttcccaggccttgtacacaccgcccgtcacaccatgggagttggtttcacccgaaggctgtgcgctaaccgcaaggaggcagcagaccacggtgggatcagcgactggggtgaagtcgtaacaaggtagccgtaggggaacctgcggctggatcacctcctttctaagga

SEQ ID NO: 8545 - DNA, 1489 bp, Sphingomonas jaspsi
  ref <308>: DATABASE ACCESSION NUMBER: NCBI ACCESSION: NZ_KK073876.1
  ref <309>: DATABASE ENTRY DATE: 2019-04-01
  ref <313>: RELEVANT RESIDUES IN SEQ ID NO: (1)..(1489)
aacttgagagtttgattctggctcagaacgaacgctggcggcatgcctaacacatgcaagtcgaacgagaccttcgggtctagtggcgcacgggtgcgtaacgcgtgggaatctgcccttgggttcggaataacagttagaaatgactgctaataccggatgatgacttcggtccaaagatttatcgcccaaggatgagcccgcgtaggattagctagttggtgaggtaaaggctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcgcgtaggcggctttgtaagttagaggtgaaagcccagagctcaactctggaactgcctttaagactgcatcgctagaatcgtggagaggtgagtggaattccgagtgtagaggtgaaattcgtagatattcggaagaacaccagtggcgaaggcgactcactggacacgtattgacgctgaggtgcgaaagcgtggggagcaaacaggattagataccctggtagtccacgccgtaaacgatgatgactagctgtcggggctcatggagtttcggtggcgcagctaacgcgttaagtcatccgcctggggagtacggccgcaaggttaaaactcaaagaaattgacgggggcctgcacaagcggtggagcatgtggtttaattcgaagcaacgcgcagaaccttaccagcgtttgacatggtaggacgacttccagagatggatttctcccttcggggcctacacacaggtgctgcatggctgtcgtcagctcgtgtcgtgagatgttgggttaagtcccgcaacgagcgcaaccctcgtctttagttgctaccatttagttgggcactctaaagaaactgccggtgataagccggaggaaggtggggatgacgtcaagtcctcatggcccttacgcgctgggctacacacgtgctacaatggcggtgacagtgggcagcaaactcgcgagagtgagcaaatccccaaaaaccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgcgctaaccgcaaggaggcagctgaccacggtgggatcagcgactggggtgaagtcgtaacaaggtagccgtaggggaacctgcggctggatcacctcctttctaagga

SEQ ID NO: 8546 - DNA, 1492 bp, Sphingomonas jatrophae
  ref <308>: DATABASE ACCESSION NUMBER: NCBI ACCESSION: NZ_FOZG01000004.1
  ref <309>: DATABASE ENTRY DATE: 2019-04-01
  ref <313>: RELEVANT RESIDUES IN SEQ ID NO: (1)..(1492)
aaacttgagagtttgattctggctcagaacgaacgctggcggcatgcctaacacatgcaagtcgaacgaaggcttcggccttagtggcgcacgggtgcgtaacgcgtgggaatctgcccaaaggtacggaataactcctcgaaaggggtgctaataccgtatgatgtcgcaagaccaaagatttatcgcctttggatgagcccgcgtaggattagctagttggtggggtaaaggcctaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcaggggtgaaagcctggagctcaactccagaactgcctttgagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacaggattagataccctggtagtccacgccgtaaacgatgagaactagctgtccgggcacttggtgcttgggtggcgcagctaacgcattaagttctccgcctggggagtacggccgcaaggttaaaactcaaagaaattgacgggggcctgcacaagcggtggagcatgtggtttaattcgaagcaacgcgcagaaccttaccaacgtttgacatgcccggacgacttccagagatggatttcttcccttcggggactgggacacaggtgctgcatggctgtcgtcagctcgtgtcgtgagatgttgggttaagtcccgcaacgagcgcaaccctcgcctttagttgccatcattaagttgggcactctaaaggaaccgccggtgataagccggaggaaggtggggatgacgtcaagtcctcatggcccttacgcgttgggctacacacgtgctacaatggcggtgacagtgggcagcaaactcgcgagggtgagctaatctccaaaagccgtctcagttcggattgcactctgcaactcgagtgcatgaaggcggaatcgctagtaatcgcggatcagcatgccgcggtgaatacgttcccaggccttgtacacaccgcccgtcacaccatgggagttggattcacccgaaggcgctgcgctaacccgcaagggaggcaggcgaccacggtgggtttagcgactggggtgaagtcgtaacaaggtagccgtaggggaacctgcggctggatcacctcctttctaag

SEQ ID NO: 8547 - DNA, 1493 bp, Sphingomonas koreensis
  ref <308>: DATABASE ACCESSION NUMBER: NCBI ACCESSION: NZ_QQZD01000035.1
  ref <309>: DATABASE ENTRY DATE: 2019-04-01
  ref <313>: RELEVANT RESIDUES IN SEQ ID NO: (1)..(1493)
caaacttgagagtttgatcctggctcagaatgaacgctggcggcatgcctaacacatgcaagtcgaacgaaggcttcggccttagtggcgcacgggtgcgtaacgcgtgggaatctgcccttgggttcggaataacagttagaaatgactgctaataccggatgatgtcgtaagaccaaagatttatcgcccaaggatgagcccgcgtaggattagctagttggtgaggtaaaagctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaacttcgtgccagcagccgcggtaatacgaggggagctagcgttattcggaattactgggcgtaaagcgcacgtaggcggctttgtaagttagaggtgaaagcccggggctcaactccggaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgtccggacgatttccagagatggatttcttcccttcggggactggaacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcaactacagtgggcagcaatcccgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaag

SEQ ID NO: 8548 - DNA, 1494 bp, Sphingomonas mali
  ref <308>: DATABASE ACCESSION NUMBER: NCBI ACCESSION: NZ_BCYX01000023.1
  ref <309>: DATABASE ENTRY DATE: 2019-04-01
  ref <313>: RELEVANT RESIDUES IN SEQ ID NO: (1)..(1494)
aaacttgagagtttgatcatggctcagaatgaacgctggcggcatgcctaacacatgcaagtcgaacgagaccttcgggtctagtggcgcacgggtgcgtaacgcgtgggaatctgcccttgggttcggaataacagtgagaaattactgctaataccgaatgatgacgtaagtccaaagatttatcgcccaaggatgagcccgcgtaggattagctagttggtgaggtaaaagctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacttagtgcttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcggtgacagtgggcagcaatcccgcgagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaagga

SEQ ID NO: 8549 - DNA, 1496 bp, Sphingomonas montana
  ref <308>: DATABASE ACCESSION NUMBER: NCBI ACCESSION: NZ_MOLY01000005.1
  ref <309>: DATABASE ENTRY DATE: 2019-04-01
  ref <313>: RELEVANT RESIDUES IN SEQ ID NO: (1)..(1496)
aaacttgagagtttgattctggctcagaacgaacgctggcggcatgcctaacacatgcaagtcgaacgaaatccttcgggatttagtggcgcacgggtgcgtaacgcgtgggaatctgccccttggtacgggataacagcgggaaactgctgctaataccgtatgatgacgagagtccaaagatttatcgccgagggatgagcccgcgtaggattagctagttggtggggtaaaggcctaccaaggctacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgtacgtaggcggttttgtaagttagaggtgaaagcccggagctcaacttcggaattgcctttaagactgcatcacttgaacgtcggagaggtgagtggaattccgagtgtagaggtgaaattcgtagatattcggaagaacaccagtggcgaaggcggctcactggacgactgttgacgctgaggtacgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaagaaattgacgggggcctgcacaagcggtggagcatgtggtttaattcgaagcaacgcgcagaaccttaccaacgtttgacatccctatcgcggttaccagagatggtttccttcagttcggctggataggtgacaggtgctgcatggctgtcgtcagctcgtgtcgtgagatgttgggttaagtcccgcaacgagcgcaaccctcgcctttagttgccatcatttagttgggcactctaaaggaaccgccggtgataagccggaggaaggtggggatgacgtcaagtcctcatggcccttacgcgttgggctacacacgtgctacaatggcggtgacagtgggcagcaaactcgcaagggtgcgctaatctccaaaagccgtctcagttcggattgtactctgcaactcgagtgcatgaaggcggaatcgctagtaatcgcggatcagcatgccgcggtgaatacgttcccaggccttgtacacaccgcccgtcacaccatgggagttggattcacccgaaggcgctgcgctaaccgcaaggaggcaggcgaccacggtgggtttagcgactggggtgaagtcgtaacaaggtagccgtaggggaacctgcggctggatcacctcctttctaagga

SEQ ID NO: 8550 - DNA, 1494 bp, Sphingomonas oleivorans
  ref <308>: DATABASE ACCESSION NUMBER: NCBI ACCESSION: NZ_NWBU01000001.1
  ref <309>: DATABASE ENTRY DATE: 2019-04-01
  ref <313>: RELEVANT RESIDUES IN SEQ ID NO: (1)..(1494)
aaacttgagagtttgattctggctcagaacgaacgctggcggcatgcctaacacatgcaagtcgaacgaagccttcgggcttagtggcgcacgggtgcgtaacgcgtgggaatctgccttcaggtacggaataactcagggaaacttgagctaataccgtatgatgtcgaaagaccaaagatttatcgcctgaagatgagcccgcgtaggattagctagttggtggggtaaaggcctaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggcttgataagttagaggtgaaagcctggagctcaacttcagaattgcctttaagactgtctcgcttgaacacgggagaggtgagtggaattccgagtgtagaggtgaaattcgtagatattcggaagaacaccagtggcgaaggcggctcactggaccgttgttgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaagaaattgacgggggcctgcacaagcggtggagcatgtggtttaattcgaagcaacgcgcagaaccttaccaacgtttgacatccctatcgcggttaccagagatggtttccttcagttcggctggataggtgacaggtgctgcatggctgtcgtcagctcgtgtcgtgagatgttgggttaagtcccgcaacgagcgcaaccctcgcctttagttgccatcattaagttgggcactctaaaggaaccgccggtgataagccggaggaaggtggggatgacgtcaagtcctcatggcccttacgcgttgggctacacacgtgctacaatggcaactacagtgggcagcgaacctgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaacccgcaagggaggcaggcgaccacggtgggtttagcgactggggtgaagtcgtaacaaggtagccgtaggggaacctgcggctggatcacctcctttctaag

SEQ ID NO: 8551 - DNA, 1498 bp, Sphingomonas panacis
  ref <308>: DATABASE ACCESSION NUMBER: NCBI ACCESSION: NZ_CP014168.1
  ref <309>: DATABASE ENTRY DATE: 2019-04-01
  ref <313>: RELEVANT RESIDUES IN SEQ ID NO: (1)..(1498)
aaacttgagagtttgatcatggctcagaatgaacgctggcggcatgcctaacacatgcaagtcgaacgaacactttcgggtgttagtggcgcacgggtgcgtaacgcgtgggaatctgccccttggttcggaataacagcgagaaattgctgctaataccggatgatgtcttcggaccaaagatttatcgccgagggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcagggctcatagagttttggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttcgggagaccgatctcttcccttcggggactggaacacaggtgctgcatggctgtcgtcagctcgtgtcgtgagatgttgggttaagtcccgcaacgagcgcaaccctcgcctttagttaccatcatttagttggggactctaaaggaaccgccggtgataagccggaggaaggtggggatgacgtcaagtcctcatggcccttacgcgctgggctacacacgtgctacaatggcaactacagtgggcagcaatcctgcaagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcagcaatgagaggcaggcgaccacggtgggcttagcgactggggtgaagtcgtaacaaggtagccgtaggggaacctgcggctggatcacctcctttctaagga

SEQ ID NO: 8552 - DNA, 1500 bp, Sphingomonas parapaucimobilis
  ref <308>: DATABASE ACCESSION NUMBER: NCBI ACCESSION: NZ_BBPI01000114.1
  ref <309>: DATABASE ENTRY DATE: 2019-04-01
  ref <313>: RELEVANT RESIDUES IN SEQ ID NO: (1)..(1500)
tcaaacttgagagtttgatcctggctcagaacgaacgctggcggcatgcctaacacatgcaagtcgaacgaggcccttcggggtttagtggcgcacgggtgcgtaacgcgtgggaatctgccctttggttcggaataacagctggaaacggctgctaataccggatgatgacgagagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgcaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctctttccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacctagcaataggaagcaggcgaccacggtgggttcagcgactggggtgaagtcgtaacaaggtagccgtaggggaacctgcggctggatcacctcctttctaagga

SEQ ID NO: 8553 - DNA, 1495 bp, Sphingomonas paucimobilis
  ref <308>: DATABASE ACCESSION NUMBER: NCBI ACCESSION: NZ_UGZC01000001.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgaaggcttcggccttagtggcgcacgggtgcgtaacgcgtgggaatctgcccttaggttcggaataacagctggaaacggctgctaataccggatgatatcgcgagatcaaagatttatcgcctgaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatggtaggacgacttccagagatggatttcttcccttcggggacctacacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacctagcaataggaagcaggcgaccacggtgggttcagcgactggggtgaagtcgtaacaaggtagccgtaggggaacctgcggctggatcacctcctttctaag

SEQ ID NO: 8554 - DNA, 1496 bp, Sphingomonas phyllosphaerae
  ref <308>: DATABASE ACCESSION NUMBER: NCBI ACCESSION: NZ_KE386571.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcctaacacatgcaagtcgaacgatgctttcgggcatagtggcgcacgggtgcgtaacgcgtgggaatctgcccttgggtctgggataacagttggaaacgactgctaataccggatgatatcgcgagatcaaagatttatcgcccgaggatgagcccgcgtcagattagctagttggtggggtaaaggcctaccaaggcgacgatctgtagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggctttgtaagtcaggggtgaaagcctggagctcaactccagaactgcctttgagactgcatcgcttgaatccgggagaggtaagtggaattccgagtgtagaggtgaaattcgtagatattcggaagaacaccagtggcgaaggcggcttactggaccgggattgacgctgaggtgagaaagcgtggggagcaaacaggattagataccctggtagtccacgccgtaaacgatgataactagctgtccggggacctggtctttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcgactacagtgggctgcaatcccgcgagggtgagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaacccgtaagggaggcaggcgaccacggtgggcttagcgactggggtgaagtcgtaacaaggtagccgtaggggaacctgcggctggatcacctcctttctaagga

SEQ ID NO: 8555 - DNA, 668 bp, Sphingomonas pituitosa
  ref <308>: DATABASE ACCESSION NUMBER: NCBI ACCESSION: NZ_BCYY01000071.1
  ref <309>: DATABASE ENTRY DATE: 2019-04-01
  ref <313>: RELEVANT RESIDUES IN SEQ ID NO: (1)..(668)
ggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatggtaggacgacttccagagatggatttcttcccttcggggacctacacacaggtgctgcatggc

SEQ ID NO: 8556 - DNA, 1494 bp, Sphingomonas pruni
  ref <308>: DATABASE ACCESSION NUMBER: NCBI ACCESSION: NZ_BCYZ01000050.1
  ref <309>: DATABASE ENTRY DATE: 2019-04-01
  ref <313>: RELEVANT RESIDUES IN SEQ ID NO: (1)..(1494)
aaacttgagagtttgatcatggctcagaatgaacgctggcggcatgcctaacacatgcaagtcgaacgagaccttcgggtctagtggcgcacgggtgcgtaacgcgtgggaatctgcccttgggttcggaataacagtgagaaattactgctaataccgaatgatgacgtaagtccaaagatttatcgcccagggatgagcccgcgtaggattagctagttggtgaggtaaaagctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacttagtgcttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcattcagttgggtactctaaaggaaccgccggtgataagccggaggaaggtggggatgacgtcaagtcctcatggcccttacgcgctgggctacacacgtgctacaatggcggtgacagtgggcagcaatcccgcgagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaagga

SEQ ID NO: 8557 - DNA, 1496 bp, Sphingomonas sanguinis
  ref <308>: DATABASE ACCESSION NUMBER: NCBI ACCESSION: NZ_BCTY01000091.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcctaacacatgcaagtcgaacgaaggcttcggccttagtggcgcacgggtgcgtaacgcgtgggaatctgcccttaggttcggaataacagctggaaacggctgctaataccggatgatgacgaaagtccaaagatttatcgcctgaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacggtgggttcagcgactggggtgaagtcgtaacaaggtagccgtaggggaacctgcggctggatcacctcctttctaagga

SEQ ID NO: 8558 - DNA, 1496 bp, Sphingomonas sanxanigenens
  ref <308>: DATABASE ACCESSION NUMBER: NCBI ACCESSION: NZ_CP006644.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcctaacacatgcaagtcgaacgagaccttcgggtctagtggcgcacgggtgcgtaacgcgtgggaatctgcccttgggttcggaataactcagagaaatttgagctaataccggatgatgtcgagagaccaaagatttatcgcccagggatgagcccgcgtaggattagctagttggtgaggtaaaggctcaccaaggcgacgatccttagctggtctgagaggatgatcagccacactgggactgagacacggcccagactcctacgggaggcagcagtggggaatattggacaatgggcgcaagcctgatccagcaatgccgcgtgagtgatgaaggccctagggttgtaaagctcttttacccgggatgataatgacagtaccgggagaataagccccggctaactccgtgccagcagccgcggtaatacggagggggctagcgttgttcggaattactgggcgtaaagcgcacgtaggcggctttgtaagttagaggtgaaagcctggagctcaacttcagaatagcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatggctagtatgggtctcagagatggggtccttcagttcggctggctagcacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggctgcgaactcgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgcgctaaccgcaaggaggcagctgaccacggtgggatcagcgactggggtgaagtcgtaacaaggtagccgtaggggaacctgcggctggatcacctcctttctaagga

SEQ ID NO: 8559 - DNA, 1494 bp, Sphingomonas soli
  ref <308>: DATABASE ACCESSION NUMBER: NCBI ACCESSION: NZ_BCTZ01000019.1
  ref <309>: DATABASE ENTRY DATE: 2019-04-01
  ref <313>: RELEVANT RESIDUES IN SEQ ID NO: (1)..(1494)
aaacttgagagtttgatcatggctcagaatgaacgctggcggcatgcctaacacatgcaagtcgaacgaaggcttcggccttagtggcgcacgggtgcgtaacgcgtgggaatctgcccttgggtttggaataacagttagaaatgactgctaataccaaataatgtcgcaagaccaaagatttatcgcccaaggatgagcccgcgtaggattagctagttggtgaggtaaaagctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgtacgtaggcggctttgcaagttagaggtgaaagcctggagctcaactccagaactgcctttaaaactgcatcgcttgaatccaggagaggtgagtggaattccgagtgtagaggtgaaattcgtagatattcggaagaacaccagtggcgaaggcggctcactggactggtattgacgctgaggtacgaaagcgtggggagcaaacaggattagataccctggtagtccacgccgtaaacgatgataactagctgtctgggtacttggtacttaggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgcccggacggtttccagagatggattccttcccttcggggactgggacacaggtgctgcatggctgtcgtcagctcgtgtcgtgagatgttgggttaagtcccgcaacgagcgcaaccctcgcctttagttaccatcattcagttggggactctaaaggaaccgccggtgataagccggaggaaggtggggatgacgtcaagtcctcatggcccttacgcgctgggctacacacgtgctacaatggcgactacagtgggcagcaattccgcgaggatgagctaatctccaaaagtcgtctcagttcggattgcactctgcaactcgagtgcatgaaggcggaatcgctagtaatcgcggatcagcatgccgcggtgaatacgttcccaggccttgtacacaccgcccgtcacaccatgggagttggattcacccgaaggcgttgcgctaactcgcaagagaggcaggcgaccacggtgggtttagcgactggggtgaagtcgtaacaaggtagccgtaggggaacctgcggctggatcacctcctttctaagga

SEQ ID NO: 8560 - DNA, 1494 bp, Sphingomonas sp. 3-7
  ref <308>: DATABASE ACCESSION NUMBER: NCBI ACCESSION: NZ_SGIS01000135.1
  ref <309>: DATABASE ENTRY DATE: 2019-04-01
  ref <313>: RELEVANT RESIDUES IN SEQ ID NO: (1)..(1494)
aaacttgagagtttgatcatggctcagaatgaacgctggcggcatgcctaacacatgcaagtcgaacgaacactttcgggtgttagtggcgcacgggtgcgtaacgcgtgggaatctgccccttggttcggaataacagcgagaaattgctgctaataccggatgatgtcttcggaccaaagatttatcgccgagggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcagggctcatagagttttggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgacttcgagagatcgatttcttcccttcggggactggaacacaggtgctgcatggctgtcgtcagctcgtgtcgtgagatgttgggttaagtcccgcaacgagcgcaaccctcgcctttagttaccatcatttagttggggactctaaaggaaccgccggtgataagccggaggaaggtggggatgacgtcaagtcctcatggcccttacgcgctgggctacacacgtgctacaatggcaactacagtgggcagcaatcctgcaagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgtaagagaggcaggcgaccacggtgggcttagcgactggggtgaagtcgtaacaaggtagccgtaggggaacctgcggctggatcacctcctttctaag

SEQ ID NO: 8561 - DNA, 1495 bp, Sphingomonas sp. 35-24ZXX
  ref <308>: DATABASE ACCESSION NUMBER: NCBI ACCESSION: NZ_JROG01000005.1
  ref <309>: DATABASE ENTRY DATE: 2019-04-01
  ref <313>: RELEVANT RESIDUES IN SEQ ID NO: (1)..(1495)
aacttgagagtttgatcctggctcagaacgaacgctggcggcatgcctaacacatgcaagtcgaacgaagtcttcggacttagtggcgcacgggtgcgtaacgcgtgggaatctgcccttgggttcggaataacagtgagaaattactgctaataccggatgatgtcttcggaccaaagatttatcgcccaaggatgagcccgcgtaagattagctagttggtgaggtaaaggctcaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggctattcaagtcagaggtgaaagcccggggctcaaccccggaactgcctttgaaactagatagcttgaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatggctagtatattttccagagatggattatttcagttcggctggctagcacacaggtgctgcatggctgtcgtcagctcgtgtcgtgagatgttgggttaagtcccgcaacgagcgcaaccctcgtctttagttgccatcattcagttgggcactctaaagaaaccgccggtgataagccggaggaaggtggggatgacgtcaagtcctcatggcccttacacgctgggctacacacgtgctacaatggcggtgacagtgggcagcaagcacgcgagtgcaagctaatctctaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaacccgcaagggaggcaggcgaccacggtgggttcagcgactggggtgaagtcgtaacaaggtagccgtaggggaacctgcggctggatcacctcctttctaagga

SEQ ID NO: 8562 - DNA, 1500 bp, Sphingomonas sp. 37zxx
  ref <308>: DATABASE ACCESSION NUMBER: NCBI ACCESSION: NZ_JROH01000090.1
  ref <309>: DATABASE ENTRY DATE: 2019-04-01
  ref <313>: RELEVANT RESIDUES IN SEQ ID NO: (1)..(1500)
tcaaacttgagagtttgatcctggctcagaacgaacgctggcggcatgcctaacacatgcaagtcgaacgaaatccttcggggtttagtggcgcacgggtgcgtaacgcgtgggaatctgcccttgggttcgggataacagttggaaacgactgctaataccggatgatggcttcggcccaaagatttatcgcccagggatgagcccgcgtaggattaggtagttggtggggtaaaggctcaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagatagtgactgtaccgggagaataagctccggctaactccgtgccagcagccgcggtaatacggagggagctagcgttgttcggaattactgggcgtaaagcgcacgtaggcggctttgtaagtaagaggtgaaagcctggagctcaactccagaactgccttttagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcggggctcttagagtttcggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgactttagttaccatcatttagttgggtactctagagtaaccgccggtgataagccggaggaaggtggggatgacgtcaagtcctcatggcccttacgcgctgggctacacacgtgctacaatggcaggtacagtgggcagcaatcccgcgagggtgagctaatctccaaaacctgtctcagttcggattgcactctgcaactcgagtgcatgaaggcggaatcgctagtaatcgcggatcagcatgccgcggtgaatacgttcccaggccttgtacacaccgcccgtcacaccatgggagttggattcacccgaaggcgttgcgctaactcagcaatgagaggcaggcgaccacggtgggtttagcgactggggtgaagtcgtaacaaggtagccgtaggggaacctgcggctggatcacctcctttctaagga

SEQ ID NO: 8563 - DNA, 1495 bp, Sphingomonas sp. ABOLD
  ref <308>: DATABASE ACCESSION NUMBER: NCBI ACCESSION: NZ_QQWZ01000016.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgagatcttcggatctagtggcgcacgggtgcgtaacgcgtgggaatctgccttggggttcggaataactccccgaaaggggtgctaataccggatgatgtcgagagaccaaagatttatcgccctgagatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatggtaggacgactggcagagatgcctttcttcccttcggggacctacacacaggtgctgcatggctgtcgtcagctcgtgtcgtgagatgttgggttaagtcccgcaacgagcgcaaccctcgactttagttaccatcattaagttgggtactttaaagtaaccgccggtgataagccggaggaaggtggggatgacgtcaagtcctcatggcccttacgcgctgggctacacacgtgctacaatggcaagtacagtgggcagcaatcccgcgagggtgagctaatctccaaaacttgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcagcaatgagaggcaggcgaccacggtgggcttagcgactggggtgaagtcgtaacaaggtagccgtaggggaacctgcggctggatcacctcctttctaag

SEQ ID NO: 8564 - DNA, 1495 bp, Sphingomonas sp. ABOLE
  ref <308>: DATABASE ACCESSION NUMBER: NCBI ACCESSION: NZ_QQWY01000093.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgagatcttcggatctagtggcgcacgggtgcgtaacgcgtgggaatctgccttggggttcggaataactccccgaaaggggtgctaataccggatgatgtcgaaagaccaaagatttatcgccctgagatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatggtaggacgactggcagagatgcctttcttcccttcggggacctacacacaggtgctgcatggctgtcgtcagctcgtgtcgtgagatgttgggttaagtcccgcaacgagcgcaaccctcgactttagttaccatcattaagttgggtactttaaagtaaccgccggtgataagccggaggaaggtggggatgacgtcaagtcctcatggcccttacgcgctgggctacacacgtgctacaatggcaagtacagtgggcagcaatcccgcgagggtgagctaatctccaaaacttgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcagcaatgagaggcaggcgaccacggtgggcttagcgactggggtgaagtcgtaacaaggtagccgtaggggaacctgcggctggatcacctcctttctaag

SEQ ID NO: 8565 - DNA, 1493 bp, Sphingomonas sp. ABOLF
  ref <308>: DATABASE ACCESSION NUMBER: NCBI ACCESSION: NZ_QQWX01000042.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaacacatgcaagtcgaacgagaccttcgggtctagtggcgcacgggtgcgtaacgcgtgggaatctgcccttgggttcggaataacagttggaaacgactgctaataccggatgatgacgtaagtccaaagatttatcgcccagggatgagcccgcgtaggattagctagttggtggggtaaaggcctaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggctttgtaagttagaggtgaaagcctggagcttaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggtgcttggcatttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatggtaggacgactggcagagatgcctttcttcccttcggggacctacacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcaactacagtgggcagcaatcccgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaaggggagcaggcgaccacggtgggttcagcgactggggtgaagtcgtaacaaggtagccgtaggggaacctgcggctggatcacctcctttctaag

SEQ ID NO: 8566 - DNA, 1489 bp, Sphingomonas sp. ABOLG
  ref <308>: DATABASE ACCESSION NUMBER: NCBI ACCESSION: NZ_QQWW01000035.1
  ref <309>: DATABASE ENTRY DATE: 2019-04-01
  ref <313>: RELEVANT RESIDUES IN SEQ ID NO: (1)..(1489)
aacttgagagtttgatcatggctcagaatgaacgctggcggcatgcctgacacatgcaagtcgaacgaaggcttcggccttagtggcgcacgggtgcgtaacgcgtgggaatctgccccttggttcggaataacagttagaaatgactgctaataccggatgatgacgtaagtccaaagatttatcgccgagggatgagcccgcgtaggattagctagttggtgtggtaagagcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacaggattagataccctggtagtccacgccgtaaacgatgataactagctgtccggggacttggtccttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggtaggacggcttccagagatggattccttcccttcggggacctacacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcaactacagtgggcagcaatcccgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgtcgcgctaaccgcaaggaggcaggcgaccacggtgggtttagcgactggggtgaagtcgtaacaaggtagccgtaggggaacctgcggctggatcacctcctttctaag

SEQ ID NO: 8567 - DNA, 1496 bp, Sphingomonas sp. ABOLH
  ref <308>: DATABASE ACCESSION NUMBER: NCBI ACCESSION: NZ_QQWV01000079.1
  ref <309>: DATABASE ENTRY DATE: 2019-04-01
  ref <313>: RELEVANT RESIDUES IN SEQ ID NO: (1)..(1496)
caaacttgagagtttgatcctggctcagaacgaacgctggcggcatgcctaacacatgcaagtcgaacgagatccttcggggtctagtggcgcacgggtgcgtaacgcgtgggaatctgcccttaggttcggaataacagttagaaatgactgctaataccggatgatgacgttaagtccaaagatttatcgcctgaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgtccggacgacttcgagagatcgatttcttcccttcggggactggaacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcaggtacagtgggcagcaatcccgcgagggtgagctaatctccaaaacctgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgtaagggaagcaggcgaccacggtgggttcagcgactggggtgaagtcgtaacaaggtagccgtaggggaacctgcggctggatcacctcctttctaag

SEQ ID NO: 8568 - DNA, 1496 bp, Sphingomonas sp. ATCC 31555
  ref <308>: DATABASE ACCESSION NUMBER: NCBI ACCESSION: NZ_ALBQ01000051.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcctaacacatgcaagtcgaacgagaccttcgggtctagtggcgcacgggtgcgtaacgcgtgggaatctgcccttgggttcggaataactcgccgaaaggtgtgctaataccggatgatgtcgaaagaccaaagatttatcgcccgaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgaccgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggtgcttggcacttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatggtaggacgacttccagagatggatttcttcccttcggggacctacacacaggtgctgcatggctgtcgtcagctcgtgtcgtgagatgttgggttaagtcccgcaacgagcgcaaccctcgtctttagttaccatcatttagttgggtactctaaagaaaccgccggtgataagccggaggaaggtggggatgacgtcaagtcctcatggcccttacgcgctgggctacacacgtgctacaatggcaactacagtgggcagcaatcccgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaactcgcaagagaggcaggcgaccacggtgggtttagcgactggggtgaagtcgtaacaaggtagccgtaggggaacctgcggctggatcacctcctttctaagga

SEQ ID NO: 8569 - DNA, 1491 bp, Sphingomonas sp. Ag1
  ref <308>: DATABASE ACCESSION NUMBER: NCBI ACCESSION: NZ_LAZX01000092.1
  ref <309>: DATABASE ENTRY DATE: 2019-04-01
  ref <313>: RELEVANT RESIDUES IN SEQ ID NO: (1)..(1491)
aacttgagagtttgatcatggctcagaatgaacgctggcggcatgcctaacacatgcaagtcgaacgaaggcttcggccttagtggcgcacgggtgcgtaacgcgtgggaatctgccccttggttcggaataacagttagaaatgactgctaataccggatgatgacgtaagtccaaagatttatcgccgagggatgagcccgcgtaggattagctagttggtgtggtaagagcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacaggattagataccctggtagtccacgccgtaaacgatgataactagctgtccggggacttggtccttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggtaggacggcttccagagatggattccttcccttcggggacctacacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcaactacagtgggcagcaatcccgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgtcgcgctaaccgcaaggaggcaggcgaccacggtgggtttagcgactggggtgaagtcgtaacaaggtagccgtaggggaacctgcggctggatcacctcctttctaagga

SEQ ID NO: 8570 - DNA, 1491 bp, Sphingomonas sp. Ant20
  ref <308>: DATABASE ACCESSION NUMBER: NCBI ACCESSION: NZ_JRVI01000298.1
  ref <309>: DATABASE ENTRY DATE: 2019-04-01
  ref <313>: RELEVANT RESIDUES IN SEQ ID NO: (1)..(1491)
aaacttgagagtttgatcatggctcagaatgaacgctggcggcatgcctaacacatgcaagtcgaacgaagccttcgggtttagtggcgcacgggtgcgtaacgcgtgggaatctgccccttggttcggaataacagttggaaacgactgctaataccggatgatgacgtaagtccaaagatttatcgccgagggatgagcccgcgtaggattaggtagttggtgtggtaaaggcgcaccaagccgacgatccttagctggtctgagaggatgatcagcacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggcaggacgacttctggagacagatttcttcccttcggggacctgcacacaggtgctgcatggctgtcgtcagctcgtgtcgtgagatgttgggttaagtcccgcaacgagcgcaaccctcgaccttagttgccatcatttagttgggcactttaaggtaaccgccggtgataagccggaggaaggtggggatgacgtcaagtcctcatggcccttacgcgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaactcgcaagagaggcaggcgaccacggtgggtttagcgactggggtgaagtcgtaacaaggtagccgtaggggaacctgcggctggatcacctcctttctaag

SEQ ID NO: 8571 - DNA, 1497 bp, Sphingomonas sp. BHC-A; identical to SEQ ID NO: 8483
  ref <308>: DATABASE ACCESSION NUMBER: NCBI ACCESSION: NZ_KL649693.1
  ref <309>: DATABASE ENTRY DATE: 2019-04-01
  ref <313>: RELEVANT RESIDUES IN SEQ ID NO: (1)..(1497)

SEQ ID NO: 8572 - DNA, 1491 bp, Sphingomonas sp. C8-2
  ref <308>: DATABASE ACCESSION NUMBER: NCBI ACCESSION: NZ_CP034357.1
  ref <309>: DATABASE ENTRY DATE: 2019-04-01
  ref <313>: RELEVANT RESIDUES IN SEQ ID NO: (1)..(1491)
aacttgagagtttgattctggctcagaacgaacgctggcggcatgcctaacacatgcaagtcgaacgaaggcttcggccttagtggcgcacgggtgcgtaacgcgtgggaatctgcccttgggtacggaataactctccgaaaggagtgctaataccgtatgatgacgaaagtccaaagatttatcgcctgaggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagttagaggtgaaagcccggggctcaaccccggaattgcctttaagactgcatcgcttgaacgtcggagaggtgagtggaattccgagtgtagaggtgaaattcgtagatattcggaagaacaccagtggcgaaggcggctcactggacgactgttgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaagaaattgacgggggcctgcacaagcggtggagcatgtggtttaattcgaagcaacgcgcagaaccttaccaacgtttgacatccctagtatggttagtggagacactttccttcagttcggctggctaggtgacaggtgctgcatggctgtcgtcagctcgtgtcgtgagatgttgggttaagtcccgcaacgagcgcaaccctcgcctttagttgccatcattaagttgggtactctaaaggaaccgccggtgataagccggaggaaggtggggatgacgtcaagtcctcatggcccttacgcgttgggctacacacgtgctacaatggcaactacagtgggcagcaatcccgcgagggcgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaaccgcaaggaggcaggcgaccacggtgggtttagcgactggggtgaagtcgtaacaaggtagccgtaggggaacctgcggctggatcacctcctttctaag

SEQ ID NO: 8573 - DNA, 1494 bp, Sphingomonas sp. CCH10-B3
  ref <308>: DATABASE ACCESSION NUMBER: NCBI ACCESSION: NZ_LSIJ01000101.1
  ref <309>: DATABASE ENTRY DATE: 2019-04-01
  ref <313>: RELEVANT RESIDUES IN SEQ ID NO: (1)..(1494)
tcaaacttgagagtttgatcctggctcagaacgaacgctggcggcatgcctaacacatgcaagtcgaacgagaccttcgggtctagtggcgcacgggtgcgtaacgcgtgggaatctgccccttggttcggaataacagcgagaaattgctgctaataccggataatgacgtaagtccaaagatttatcgccaagggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagctccggctaactccgtgccagcagccgcggtaatacggagggagctagcgttgttcggaattactgggcgtaaagcgcacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcagggttcttagaactttggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgtccggacgactggcagagatgcctttcttcccttcggggactggaacacaggtgctgcatggctgtcgtcagctcgtgtcgtgagatgttgggttaagtcccgcaacgagcgcaaccctcgtctttagttaccatcattcagttgggtactctaaagaaaccgccggtgataagccggaggaaggtggggatgacgtcaagtcctcatggcccttacgcgctgggctacacacgtgctacaatggcgactacagtgggctgcaatcccgcgagggtgagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgcgctaaccgcaaggaggcagctgaccacggtgggatcagcgactggggtgaagtcgtaacaaggtagccgtaggggaacctgcggctggatcacctcctttctaagga

SEQ ID NO: 8574 - DNA, 1494 bp, Sphingomonas sp. CCH13-B11
  ref <308>: DATABASE ACCESSION NUMBER: NCBI ACCESSION: NZ_LSKP01000004.1
  ref <309>: DATABASE ENTRY DATE: 2019-04-01
  ref <313>: RELEVANT RESIDUES IN SEQ ID NO: (1)..(1494)
tcaaacttgagagtttgatcctggctcagaacgaacgctggcggcatgcctaacacatgcaagtcgaacgaaggcttcggccttagtggcgcacgggtgcgtaacgcgtgggaatctgcccttgggtttggaataacagcgagaaattgctgctaataccaaataatgtcgcaagaccaaagatttatcgcccaaggatgagcccgcgtaggattagctagttggtgaggtaaaagctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgagatgataatgacagtatcgggagaataagctccggctaactccgtgccagcagccgcggtaatacggagggagctagcgttgttcggaattactgggcgtaaagcgcacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggctcttagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgtccggacgattcccagagatgggtctcttcccttcggggactggaacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggtaactacagtgggcagcaatcccgcgagggtgagctaatctccaaaagttatctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggtggtgcgctaaccgcaaggaggcagccaaccacggtgggttcagcgactggggtgaagtcgtaacaaggtagccgtaggggaacctgcggctggatcacctcctttctaagga

SEQ ID NO: 8575 - DNA, 1494 bp, Sphingomonas sp. CCH15-F11
  ref <308>: DATABASE ACCESSION NUMBER: NCBI ACCESSION: NZ_LSKG01000111.1
  ref <309>: DATABASE ENTRY DATE: 2019-04-01
  ref <313>: RELEVANT RESIDUES IN SEQ ID NO: (1)..(1494)
tcaaacttgagagtttgatcctggctcagaacgaacgctggcggcatgcctaacacatgcaagtcgaacgaaggcttcggccttagtggcgcacgggtgcgtaacgcgtgggaatctgcccttgggtttggaataacagcgagaaattgctgctaataccaaataatgtcgcaagaccaaagatttatcgcccaaggatgagcccgcgtaggattagctagttggtgaggtaaaagctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgagatgataatgacagtatcgggagaataagctccggctaactccgtgccagcagccgcggtaatacggagggagctagcgttgttcggaattactgggcgtaaagcgcacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgagctcttagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgtccggacgattcccagagatgggtctcttcccttcggggactggaacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggtaactacagtgggcagcaatcccgcgagggtgagctaatctccaaaagttatctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggtggtgcgctaaccgcaaggaggcagccaaccacggtgggttcagcgactggggtgaagtcgtaacaaggtagccgtaggggaacctgcggctggatcacctcctttctaagga

SEQ ID NO: 8576 - DNA, 1494 bp, Sphingomonas sp. CCH16-B10; identical to SEQ ID NO: 8574
  ref <308>: DATABASE ACCESSION NUMBER: NCBI ACCESSION: NZ_LSIE01000073.1
  ref <309>: DATABASE ENTRY DATE: 2019-04-01
  ref <313>: RELEVANT RESIDUES IN SEQ ID NO: (1)..(1494)

SEQ ID NO: 8577 - DNA, 1494 bp, Sphingomonas sp. CCH18-H6; identical to SEQ ID NO: 8575
  ref <308>: DATABASE ACCESSION NUMBER: NCBI ACCESSION: NZ_LSKI01000132.1
  ref <309>: DATABASE ENTRY DATE: 2019-04-01
  ref <313>: RELEVANT RESIDUES IN SEQ ID NO: (1)..(1494)

SEQ ID NO: 8578 - DNA, 1494 bp, Sphingomonas sp. CCH19-C6; identical to SEQ ID NO: 8574
  ref <308>: DATABASE ACCESSION NUMBER: NCBI ACCESSION: NZ_LSKD01000014.1
  ref <309>: DATABASE ENTRY DATE: 2019-04-01
  ref <313>: RELEVANT RESIDUES IN SEQ ID NO: (1)..(1494)

SEQ ID NO: 8579 - DNA, 1494 bp, Sphingomonas sp. CCH20-B6; identical to SEQ ID NO: 8574
  ref <308>: DATABASE ACCESSION NUMBER: NCBI ACCESSION: NZ_LSJC01000213.1
  ref <309>: DATABASE ENTRY DATE: 2019-04-01
  ref <313>: RELEVANT RESIDUES IN SEQ ID NO: (1)..(1494)

SEQ ID NO: 8580 - DNA, 1494 bp, Sphingomonas sp. CCH21-G11; identical to SEQ ID NO: 8574
  ref <308>: DATABASE ACCESSION NUMBER: NCBI ACCESSION: NZ_LSHX01000052.1
  ref <309>: DATABASE ENTRY DATE: 2019-04-01
  ref <313>: RELEVANT RESIDUES IN SEQ ID NO: (1)..(1494)

SEQ ID NO: 8581 - DNA, 1494 bp, Sphingomonas sp. CCH5-A5; identical to SEQ ID NO: 8574
  ref <308>: DATABASE ACCESSION NUMBER: NCBI ACCESSION: NZ_LSHQ01000026.1
  ref <309>: DATABASE ENTRY DATE: 2019-04-01
  ref <313>: RELEVANT RESIDUES IN SEQ ID NO: (1)..(1494)

SEQ ID NO: 8582 - DNA, 1492 bp, Sphingomonas sp. CCH5-D11
  ref <308>: DATABASE ACCESSION NUMBER: NCBI ACCESSION: NZ_LSKH01000307.1
  ref <309>: DATABASE ENTRY DATE: 2019-04-01
  ref <313>: RELEVANT RESIDUES IN SEQ ID NO: (1)..(1492)
aaacttgagagtttgatcatggctcagaacgaacgctggcggcatgcctaacacatgcaagtcgaacgagatcttcggatctagtggcgcacgggtgcgtaacgcgtgggaatctgccccttggttcggaataacagttagaaatgactgctaataccggatgacgacgtaagtccaaagatttatcgccgagggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagttagaggtgaaagcctggagctcaactccagaattgcctttaagactgcatcgctcgaatccgggagaggtgagtggaattccgagtgtagaggtgaaattcgtagatattcggaagaacaccagtggcgaaggcggctcactggaccggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggtaggacgactggcagagatgcctttcttcccttcggggacctacacacaggtgctgcatggctgtcgtcagctcgtgtcgtgagatgttgggttaagtcccgcaacgagcgcaaccctcgcctttagttaccatcattcagttgggtactctaaaggaaccgccggtgataagccggaggaaggtggggatgacgtcaagtcctcatggcccttacgcgctgggctacacacgtgctacaatggcaactacagtgggcagcaatcccgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgtcgcgctaaccgcaaggaggcaggcgaccacggtgggtttagcgactggggtgaagtcgtaacaaggtagccgtaggggaacctgcggctggatcacctcctttctaagga

SEQ ID NO: 8583 - DNA, 1496 bp, Sphingomonas sp. CCH9-E2
  ref <308>: DATABASE ACCESSION NUMBER: NCBI ACCESSION: NZ_LSJM01000436.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaatgaacgctggcggcatgcctaacacatgcaagtcgaacgaaggcttcggccttagtggcgcacgggtgcgtaacgcgtgggaatctgcccttgggttcggaataacagttagaaatgactgctaataccggatgatgtcgtaagaccaaagatttatcgcccaaggatgagcccgcgtaggattagctagttggcggggtaaaggcccaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaacttcgtgccagcagccgcggtaatacgaggggagctagcgttattcggaattactgggcgtaaagcgcacgtaggcggctttgtaagttagaggtgaaagcccagagctcaactctggaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgtccggacgatttccagagatggatttcttcccttcggggactggaacacaggtgctgcatggctgtcgtcagctcgtgtcgtgagatgttgggttaagtcccgcaacgagcgcaaccctcgcctttagttaccatcattcagttgggtactctaaaggaaccgccggtgataagccggaggaaggtggggatgacgtcaagtcctcatggcccttacgcgctgggctacacacgtgctacaatggcgactacagtgggcagcaatcccgcgagggtgagctaatctccaaaagtcgtctcagttcggattgcactctgcaactcgagtgcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaagga

SEQ ID NO: 8584 - DNA, 1496 bp, Sphingomonas sp. CCH9-F2
  ref <308>: DATABASE ACCESSION NUMBER: NCBI ACCESSION: NZ_LSJO01000253.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcctaacacatgcaagtcgaacgaaggcttcggccttagtggcgcacgggtgcgtaacgcgtgggaatctgcccttgggttcggaataacagttggaaacgactgctaataccggatgatgtcgcgagaccaaagatttatcgcccagggatgagcccgcgtcggattaggtagttggtggggtaaaggcctaccaagccgacgatccgtagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagtcaggggtgaaagcctggagctcaactccagaactgcctttgagactgcatcgcttgaatccgggagaggtgagtggaattccgagtgtagaggtgaaattcgtagatattcggaagaacaccagtggcgaaggcggctcactggaccggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgattcccagagatgggtctcttcccttcggggactggaacacaggtgctgcatggctgtcgtcagctcgtgtcgtgagatgttgggttaagtcccgcaacgagcgcaaccctcgcctttagttaccatcattcagttgggtactctaaaggaaccgccggtgataagccggaggaaggtggggatgacgtcaagtcctcatggcccttacgcgctgggctacacacgtgctacaatggcgactacagtgggctgcaatcccgcgagggtgagctaatctccaaaagtcgtctcagttcggattgctctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaagga

SEQ ID NO: 8585 - DNA, 1496 bp, Sphingomonas sp. CCH9-H8; identical to SEQ ID NO: 8583
  ref <308>: DATABASE ACCESSION NUMBER: NCBI ACCESSION: NZ_LSJF01000595.1
  ref <309>: DATABASE ENTRY DATE: 2019-04-01
  ref <313>: RELEVANT RESIDUES IN SEQ ID NO: (1)..(1496)

SEQ ID NO: 8586 - DNA, 1489 bp, Sphingomonas sp. CCP-7
  ref <308>: DATABASE ACCESSION NUMBER: NCBI ACCESSION: NZ_SACN01000008.1
  ref <309>: DATABASE ENTRY DATE: 2019-04-01
  ref <313>: RELEVANT RESIDUES IN SEQ ID NO: (1)..(1489)
aacttgagagtttgattctggctcagaacgaacgctggcggcatgcctaacacatgcaagtcgaacggatccttcgggattagtggcgcacgggtgcgtaacgcgtgggaatctgccctggggtacggaataactcggagaaatccgtgctaataccgtatgatgtcttcggaccaaagatttatcgccctgggatgagcccgcgtaggattagctagttggtggggtaaaggcctaccaaggcgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagttagaggtgaaagcccggggctcaactccggaactgcctttaagactgcatcgctagaacgtcggagaggtgagtggaattccgagtgtagaggtgaaattcgtagatattcggaagaacaccagtggcgaaggcggctcactggacgactgttgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaagaaattgacgggggcctgcacaagcggtggagcatgtggtttaattcgaagcaacgcgcagaaccttaccaacgtttgacatgcccggacgactggcagagatgcctttcttcccttcggggactgggacacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcggtgacagtgggcagcaagcgggcgaccgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaaccgcaaggaggcaggcgaccacggtgggtttagcgactggggtgaagtcgtaacaaggtagccgtaggggaacctgcggctggatcacctcctttctaag

SEQ ID NO: 8587 - DNA, 1493 bp, Sphingomonas sp. CF311
  ref <308>: DATABASE ACCESSION NUMBER: NCBI ACCESSION: NZ_QEOD01000005.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaacacatgcaagtcgaacgagaccttcgggtctagtggcgcacgggtgcgtaacgcgtgggaatctgcccttgggttcggaataactcgccgaaaggcgtgctaataccggatgatgtcgtaagaccaaagatttatcgcccaaggatgagcccgcgtaagattaggtagttggtgaggtaaaggctcaccaagccgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatggtaggacgactggcagagatgcctttcttcccttcggggacctacacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcaactacagtgggcagcaatcccgcgagggtgagctaatctccaaaagttgtctcagttcggattgtactctgcaactcgagtgcatgaaggcggaatcgctagtaatcgcggatcagcatgccgcggtgaatacgttcccaggccttgtacacaccgcccgtcacaccatgggagttggattcacccgaaggcgttgcgctaactcgcaagagaggcaggcgaccacggtgggtttagcgactggggtgaagtcgtaacaaggtagccgtaggggaacctgcggctggatcacctcctttctaag

SEQ ID NO: 8588 - DNA, 1492 bp, Sphingomonas sp. Cra20
  ref <308>: DATABASE ACCESSION NUMBER: NCBI ACCESSION: NZ_CP024923.1
  ref <309>: DATABASE ENTRY DATE: 2019-04-01
  ref <313>: RELEVANT RESIDUES IN SEQ ID NO: (1)..(1492)
aaacttgagagtttgatcatggctcagaatgaacgctggcggcatgcctaacacatgcaagtcgaacgaaggcttcggccttagtggcgcacgggtgcgtaacgcgtgggaatctgccttggggttcggaataactccccgaaaggggtgctaataccggatgatgtcgaaagaccaaagatttatcgccctgagatgagcccgcgtaagattagctagttggtggggtaaaggcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtctgggcacttggtgttcaggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgcccggacgacttccagagatggatttcttcccttcggggactgggacacaggtgctgcatggctgtcgtcagctcgtgtcgtgagatgttgggttaagtcccgcaacgagcgcaaccctcgcctctagttaccatcatttagttgggtactttagaggaaccgccggtgataagccggaggaaggtggggatgacgtcaagtcctcatggcccttacgcgctgggctacacacgtgctacaatggcgactacagtgggcagcaaactcgcgagggtgagctaatctccaaaagtcgtctcagttcggattgcactctgcaactcgagtgcatgaaggcggaatcgctagtaatcgcggatcagcatgccgcggtgaatacgttcccaggccttgtacacaccgcccgtcacaccatgggagttggattcacccgaaggcgttgcgctaactcgcaagagaggcaggcgaccacggtgggtttagcgactggggtgaagtcgtaacaaggtagccgtaggggaacctgcggctggatcacctcctttctaag

SEQ ID NO: 8589 - DNA, 1489 bp, Sphingomonas sp. DAC4
  ref <308>: DATABASE ACCESSION NUMBER: NCBI ACCESSION: NZ_QXTF01000001.1
  ref <309>: DATABASE ENTRY DATE: 2019-04-01
  ref <313>: RELEVANT RESIDUES IN SEQ ID NO: (1)..(1489)
aacttgagagtttgattctggctcagaacgaacgctggcggcatgcctaacacatgcaagtcgaacgagaccttcgggtctagtggcgcacgggtgcgtaacgcgtgggaatctgcccttgggttcgggataacagttggaaacgactgctaataccggatgatgacttcggtccaaagatttatcgcccagggatgagcccgcgtcggattagctagttggtgaggtaaaggctcaccaaggcgacgatccgtagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcgcgtaggcggctttgtaagttagaggtgaaagcccggagctcaactccggaactgcctttaagactgcatcgctagaatcgtggagaggtgagtggaattccgagtgtagaggtgaaattcgtagatattcggaagaacaccagtggcgaaggcgactcactggacacgtattgacgctgaggtgcgaaagcgtggggagcaaacaggattagataccctggtagtccacgccgtaaacgatgatgactagctgtcggggctcatggagtttcggtggcgcagctaacgcgttaagtcatccgcctggggagtacggccgcaaggttaaaactcaaagaaattgacgggggcctgcacaagcggtggagcatgtggtttaattcgaagcaacgcgcagaaccttaccagcgtttgacatggtaggacggtttccagagatggattccttcccttacgggacctacacacaggtgctgcatggctgtcgtcagctcgtgtcgtgagatgttgggttaagtcccgcaacgagcgcaaccctcgcctttagttaccatcatttagttgggtactctagaggaactgccggtgataagccggaggaaggtggggatgacgtcaagtcctcatggcccttacgcgctgggctacacacgtgctacaatggcggtgacagtgagcagcgaccccgcgagggtgagctaatctccaaaaaccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgcgctaaccgcaaggaggcagctgaccacggtgggatcagcgactggggtgaagtcgtaacaaggtagccgtaggggaacctgcggctggatcacctcctttctaag

SEQ ID NO: 8590 - DNA, 1496 bp, Sphingomonas sp. ERG5
  ref <308>: DATABASE ACCESSION NUMBER: NCBI ACCESSION: NZ_JSXI01000050.1
  ref <309>: DATABASE ENTRY DATE: 2019-04-01
  ref <313>: RELEVANT RESIDUES IN SEQ ID NO: (1)..(1496)
aaacttgagagtttgatcatggctcagaatgaacgctggcggcatgcctaacacatgcaagtcgaacgagaccttcgggtctagtggcgcacgggtgcgtaacgcgtgggaatctgcccttgggttcggaataacagctagaaatggctgctaataccggatgatgacgtaagtccaaagatttatcgcccaaggatgagcccgcgtaggattagctagttggtgaggtaaaagctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcggggctcttagagcttcggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggctagtatgatttccagagatggatttcttcagttcggctggctagcacacaggtgctgcatggctgtcgtcagctcgtgtcgtgagatgttgggttaagtcccgcaacgagcgcaaccctcgtccttagttgccatcattaagttgggcactctaaggaaaccgccggtgataagccggaggaaggtggggatgacgtcaagtcctcatggcccttacgcgctgggctacacacgtgctacaatggcggtgacagtgggcagcaatcccgcaagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggtagtgcgctaacccgcaagggaggcagctaaccacggtgggttcagcgactggggtgaagtcgtaacaaggtagccgtaggggaacctgcggctggatcacctcctttctaagga

SEQ ID NO: 8591 - DNA, 1493 bp, Sphingomonas sp. FARSPH
  ref <308>: DATABASE ACCESSION NUMBER: NCBI ACCESSION: NZ_CP029985.1
  ref <309>: DATABASE ENTRY DATE: 2019-04-01
  ref <313>: RELEVANT RESIDUES IN SEQ ID NO: (1)..(1493)
aaacttgagagtttgatcatggctcagaacgaacgctggcggcatgcctaacacatgcaagtcgaacgagatcttcgggtctagtggcgcacgggtgcgtaacgcgtgggaatctgccctttggttcggaataacagttggaaacgactgctaataccggatgatgacgttaagtccaaagatttatcgccagaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggatgataatgacagtaccgggagaataagccccggctaactccgtgccagcagccgcggtaatacggagggggctagcgttgttcggaattactgggcgtaaagcgcacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcattcagttgggtactctaaaggaaccgccggtgataagccggaggaaggtggggatgacgtcaagtcctcatggcccttacgcgctgggctacacacgtgctacaatggcggtgacagtgggcagcaatcccgcgagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaaggggagcaggcgaccacggtgggttcagcgactggggtgaagtcgtaacaaggtagccgtaggggaacctgcggctggatcacctcctttctaag

SEQ ID NO: 8592 - DNA, 1494 bp, Sphingomonas sp. FUKUSWIS1
  ref <308>: DATABASE ACCESSION NUMBER: NCBI ACCESSION: NZ_JPJC01000028.1
  ref <309>: DATABASE ENTRY DATE: 2019-04-01
  ref <313>: RELEVANT RESIDUES IN SEQ ID NO: (1)..(1494)
aaacttgagagtttgatcatggctcagaatgaacgctggcggcatgcctaacacatgcaagtcgaacgaagccttcgggtttagtggcgcacgggtgcgtaacgcgtgggaatctgccccttggttcggaataacagttggaaacgactgctaataccggatgatgacgtaagtccaaagatttatcgccgagggatgagcccgcgtaggattaggtagttggtgtggtaaaggcgcaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggcaggacgacttctggagacagatttcttcccttcggggacctgcacacaggtgctgcatggctgtcgtcagctcgtgtcgtgagatgttgggttaagtcccgcaacgagcgcaaccctcgaccttagttgccatcatttagttgggcactttaaggtaaccgccggtgataagccggaggaaggtggggatgacgtcaagtcctcatggcccttacgcgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaactcgcaagagaggcaggcgaccacggtgggtttagcgactggggtgaagtcgtaacaaggtagccgtaggggaacctgcggctggatcacctcctttctaagga

SEQ ID NO: 8593 - DNA, 1491 bp, Sphingomonas sp. HMF7854
  ref <308>: DATABASE ACCESSION NUMBER: NCBI ACCESSION: NZ_RWJF01000001.1
  ref <309>: DATABASE ENTRY DATE: 2019-04-01
  ref <313>: RELEVANT RESIDUES IN SEQ ID NO: (1)..(1491)
aacttgagagtttgattctggctcagaacgaacgctggcggcatgcctaacacatgcaagtcgaacgagctcttcggagctagtggcgcacgggtgcgtaacgcgtgggaatctgcccttaggttcggaataactcagggaaacttgagctaataccgaatgatgtcttcggaccaaagatttatcgcctgaggatgagcccgcgtcggattagctagttggtgaggtaaaggctcaccaaggcgacgatccgtagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggtggctttgtaagttagaggtgaaagcccggagctcaactccggaattgcctttaagactgcatcgcttgaacgtcggagaggtgagtggaattccgagtgtagaggtgaaattcgtagatattcggaagaacaccagtggcgaaggcgactcactggacgactgttgacactgaggtgcgaaagcgtggggagcaaacaggattagataccctggtagtccacgccgtaaacgatgatgactagctgtcggggctcttggagtttcggtggcgcagctaacgcgttaagtcatccgcctggggagtacggccgcaaggttaaaactcaaagaaattgacgggggcctgcacaagcggtggagcatgtggtttaattcgaagcaacgcgcagaaccttaccagcgtttgacatggtaggacgacttccagagatggatttcttcccttacgggacctacacacaggtgctgcatggctgtcgtcagctcgtgtcgtgagatgttgggttaagtcccgcaacgagcgcaaccctcgtctttagttgctatcatttagttgggcactctaaagaaactgccggtgataagccggaggaaggtggggatgacgtcaagtcctcatggcccttacgcgctgggctacacacgtgctacaatggcggtgacagtgggcagcaaactcgcgagagtgagcaaatccccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaag

SEQ ID NO: 8594 - DNA, 353 bp, Sphingomonas sp. IBVSS1
  ref <308>: DATABASE ACCESSION NUMBER: NCBI ACCESSION: NZ_NFUS01000001.1
  ref <309>: DATABASE ENTRY DATE: 2019-04-01
  ref <313>: RELEVANT RESIDUES IN SEQ ID NO: (1)..(353)
aacttgagagtttgatcctggctcagaacgaacgctggcggcatgcctaacacatgcaagtcgaacgagaccttcgggtctagtggcgcacgggtgcgtaacgcgtgggaacctgcctttaggttcggaataactcagagaaatttgagctaataccggatgatgacttcggtccaaagatttatcgcctgaagatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcc

SEQ ID NO: 8595 - DNA, 1590 bp, Sphingomonas sp. IBVSS2
  misc_feature (1343)..(1343): n is a, c, g, or t
  ref <308>: DATABASE ACCESSION NUMBER: NCBI ACCESSION: NZ_NFUR01000005.1
  ref <309>: DATABASE ENTRY DATE: 2019-04-01
  ref <313>: RELEVANT RESIDUES IN SEQ ID NO: (1)..(1590)
tcaaacttgagagtttgatcctggctcagaacgaacgctggcggcatgcctaacacatgcaagtcgaacgagaccttcgggtctagtggcgcacgggtgcgtaacgcgtgggaatctgcccttgggttcggaataactcgccgaaaggcgtgctaataccggatgatgtcgaaagaccaaagatttatcgcccagggatgagcccgcgtaagattagctagttggtgaggtaaaggctcaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttttaagtcagaggtgaaagcccggggctcaactccagaactgcctttgagactgcatcgcttgaatccaggagaggtgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttgccatcattaagttgggcactctaaaggaaccgccggtgataagccggaggaaggtggggatgacgtcaagtcctcatggcccttacgcgctgggctacacacgtgctacaatggcggtgacagtgggcagcaaactcgcgagagtgcgctaatctccaaaagccgtctcagttcggattgttctctgcaactcgagagcatgaaggcggaatcgctagtaatcgcggatcagcatgccgcggtgaatacgttcccaggccttgtacacncggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaaccgcaaggaggcaggcgaccacggtgggcttagcgactggggtgaagtcgtaacaaggtagccgtaggggaacctgcggctggatcacctcctttctaagga

SEQ ID NO: 8596 - DNA, 1495 bp, Sphingomonas sp. JJ-A5
  ref <308>: DATABASE ACCESSION NUMBER: NCBI ACCESSION: NZ_CP018221.1
  ref <309>: DATABASE ENTRY DATE: 2019-04-01
  ref <313>: RELEVANT RESIDUES IN SEQ ID NO: (1)..(1495)
aacttgagagtttgatcctggctcagaacgaacgctggcggcatgcctaacacatgcaagtcgaacgaagccttcgggcttagtggcgcacgggtgcgtaacgcgtgggaatctgccctcaggtacggaataacagctagaaatggctgctaataccgtatgatgtcttcggaccaaagatttatcgcctggggatgagcccgcgttggattagcttgttggtggggtaaaggcctaccaaggcgacgatccatagctggtctgagaggatgatcagccacactgggactgagacacggcccagactcctacgggaggcagcagtggggaatattggacaatgggggcaaccctgatccagcaatgccgcgtgagtgaagaaggccttcgggttgtaaagctcttttacccgggaagataatgactgtaccgggagaataagccccggctaactccgtgccagcagccgcggtaatacggagggggctagcgttgttcggaattactgggcgtaaagcgcgcgtaggcggcttggtaagttagaggtgaaagcccggggctcaaccccggaatagcctttaagactgcttcgcttgaacgtcggagaggtgagtggaattccgagtgtagaggtgaaattcgtagatattcggaagaacaccagtggcgaaggcggctcactggacgactgttgacgctgaggtgcgaaagcgtggggagcaaacaggattagataccctggtagtccacgccgtaaacgatgataactagctgtcggggcgcttggcgtttcggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatcccgatcgcggttggtggagacaccttccttcagttcggctggatcggtgacaggtgctgcatggctgtcgtcagctcgtgtcgtgagatgttgggttaagtcccgcaacgagcgcaaccctcgccttcagttaccatcatttagttgggtactctggaggaactgccggtgataagccggaggaaggtggggatgacgtcaagtcctcatggcccttacgcgctgggctacacacgtgctacaatggcaagtacagagggctgcaagccggcgacggtgagctaatctccaaaacttgtctcagttcggattgttctctgcaactcgagagcatgaaggcggaatcgctagtaatcgcggatcagcatgccgcggtgaatacgttcccaggccttgtacacaccgcccgtcacaccatgggagttggattgacccgaaggcagtgggctaacccgcaagggaggcagctgaccacggtcggttcagcgactggggtgaagtcgtaacaaggtagccgtaggggaacctgcggctggatcacctcctttctaagga

SEQ ID NO: 8597 - DNA, 1495 bp, Sphingomonas sp. K2R01-6
  ref <308>: DATABASE ACCESSION NUMBER: NCBI ACCESSION: NZ_QYUM01000001.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgagaccttcgggtctagtggcgcacgggtgcgtaacgcgtgggaatctgcccttgggttcggaataacagttagaaatgactgctaataccggatgatgacttcggtccaaagatttatcgcccaaggatgagcccgcgtaggattagctagttggtgaggtaaaggctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagttagaggtgaaagcccggggctcaactccggaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacatggtgcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgcctagtatggtttccagagatggattccttcagttcggctggctagtgcacaggtgctgcatggctgtcgtcagctcgtgtcgtgagatgttgggttaagtcccgcaacgagcgcaaccctcgtccttagttgccatcatttagttgggcactctaaggaaaccgccggtgataagccggaggaaggtggggatgacgtcaagtcctcatggcccttacgcgctgggctacacacgtgctacaatggcaactacagtgggcagcaaactcgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaacccgcaagggaggcaggcgaccacggtgggtttagcgactggggtgaagtcgtaacaaggtagccgtaggggaacctgcggctggatcacctcctttctaag

SEQ ID NO: 8598 - DNA, 1495 bp, Sphingomonas sp. KC8
  ref <308>: DATABASE ACCESSION NUMBER: NCBI ACCESSION: NZ_CP016306.1
  ref <309>: DATABASE ENTRY DATE: 2019-04-01
  ref <313>: RELEVANT RESIDUES IN SEQ ID NO: (1)..(1495)
aacttgagagtttgattctggctcagaacgaacgctggcggcatgcctaacacatgcaagtcgaacgaaggcttcggccttagtggcgcacgggtgcgtaacgcgtgggaatctgcccttaggtacggaataacagtgagaaattactgctaataccgtatgatgtcgcaagaccaaagatttatcgcctaaggatgagcccgcgtaggattagctagttggtgaggtaaaagctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgtacgtaggcggctttgtaagttagaggtgaaagcccggggctcaaccccggaattgcctttaagactgcatcgcttgaacgtcggagaggtgagtggaattccgagtgtagaggtgaaattcgtagatattcggaagaacaccagtggcgaaggcggctcactggacgactgttgacgctgaggtacgaaagcgtggggagcaaacaggattagataccctggtagtccacgccgtaaacgatgataactagctgtccgggtacttggtacttgggtggcgcagctaacgcattaagttatccgcctggggagtacggccgcaaggttaaaactcaaagaaattgacgggggcctgcacaagcggtggagcatgtggtttaattcgaagcaacgcgcagaaccttaccaacgtttgacatccctatcgcggttaccagagatggtttccttcagttcggctggataggtgacaggtgctgcatggctgtcgtcagctcgtgtcgtgagatgttgggttaagtcccgcaacgagcgcaaccctcgcctttagttgccatcatttagttgggcactctaaaggaaccgccggtgataagccggaggaaggtggggatgacgtcaagtcctcatggcccttacgcgttgggctacacacgtgctacaatggcaactacagtgggcagcaagccggcgacggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaacccgcaagggaggcaggcgaccacggtgggtttagcgactggggtgaagtcgtaacaaggtagccgtaggggaacctgcggctggatcacctcctttctaagga

SEQ ID NO: 8599 - DNA, 1493 bp, Sphingomonas sp. L3B27
  ref <308>: DATABASE ACCESSION NUMBER: NCBI ACCESSION: NZ_QENQ01000001.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaacacatgcaagtcgaacgagaccttcgggtctagtggcgcacgggtgcgtaacgcgtgggaatctgcccttgggttcggaataactcgccgaaaggcgtgctaataccggataatgacgaaagtccaaagatttatcgcccgaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgaccgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggtgcttggcatttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatggtaggacgacttccagagatggatttcttcccttcggggacctacacacaggtgctgcatggctgtcgtcagctcgtgtcgtgagatgttgggttaagtcccgcaacgagcgcaaccctcgactttagttaccatcattaagttgggtactttaaagtaaccgccggtgataagccggaggaaggtggggatgacgtcaagtcctcatggcccttacgcgctgggctacacacgtgctacaatggcaactacagtgggcagcaatcccgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaactcgcaagagaggcaggcgaccacggtgggtttagcgactggggtgaagtcgtaacaaggtagccgtaggggaacctgcggctggatcacctcctttctaag

SEQ ID NO: 8600 - DNA, 1495 bp, Sphingomonas sp. LH128
  ref <308>: DATABASE ACCESSION NUMBER: NCBI ACCESSION: NZ_ALVC01000093.1
  ref <309>: DATABASE ENTRY DATE: 2019-04-01
  ref <313>: RELEVANT RESIDUES IN SEQ ID NO: (1)..(1495)
aacttgagagtttgatcctggctcagaacgaacgctggcggcatgcctaacacatgcaagtcgaacgagatcttcggatctagtggcgcacgggtgcgtaacgcgtgggaatctgcccttgggttcggaataacagtgagaaattactgctaataccggatgatgtcttcggaccaaagatttatcgcccagggatgagcccgcgtaggattaggtagttggtggggtaatggcctaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggttactcaagtcagaggtgaaagcccggggctcaaccccggaactgcctttgaaactaggtgactagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggtacttggtacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgccggtcgcggatttgggagaccatttccttcagttcggctggaccgtgcacaggtgctgcatggctgtcgtcagctcgtgtcgtgagatgttgggttaagtcccgcaacgagcgcaaccctcgtccttagttgccagcatttggttgggcactctaaggaaactgccggtgataagccggaggaaggtggggatgacgtcaagtcctcatggcccttacacgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcactcgaaggcgttgagctaacccgcaagggaggcaggcgaccacagtgggtttagcgactggggtgaagtcgtaacaaggtagccgtaggggaacctgcggctggatcacctcctttctaagga

SEQ ID NO: 8601 - DNA, 1498 bp, Sphingomonas sp. LK11
  ref <308>: DATABASE ACCESSION NUMBER: NCBI ACCESSION: NZ_CP013916.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgaggcccttcggggtttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgactggcagagatgcctttcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgtaagggaagcaggcgaccacggtgggttcagcgactggggtgaagtcgtaacaaggtagccgtaggggaacctgcggctggatcacctcctttctaagga

SEQ ID NO: 8602 - DNA, 1494 bp, Sphingomonas sp. LM7
  ref <308>: DATABASE ACCESSION NUMBER: NCBI ACCESSION: NZ_CP019511.1
  ref <309>: DATABASE ENTRY DATE: 2019-04-01
  ref <313>: RELEVANT RESIDUES IN SEQ ID NO: (1)..(1494)
aaacttgagagtttgatcatggctcagaatgaacgctggcggcatgcctaacacatgcaagtcgaacgaagccttcgggcttagtggcgcacgggtgcgtaacgcgtgggaatctgccttggggttcggaataactcagagaaatttgagctaataccggatgatgtcgaaagaccaaagatttatcgccctgagatgagcccgcgtaggattagctagttggtgaggtaaaagctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttattcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtctgggtgcctagcacttaggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgcccggacgacttccagagatggatttcttcccttcggggactgggacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcgactacagtgggctgcaaactcgcgagggtgagctaatctccaaaagtcgtctcagttcggattgcactctgcaactcgagtgcatgaaggcggaatcgctagtaatcgtggatcagcatgccacggtgaatacgttcccaggccttgtacacaccgcccgtcacaccatgggagttggattcacccgaaggcgttgcgctaactcgcaagagaggcaggcgaccacggtgggtttagcgactggggtgaagtcgtaacaaggtagccgtaggggaacctgcggctggatcacctcctttctaagga

SEQ ID NO: 8603 - DNA, 1498 bp, Sphingomonas sp. Leaf10
  ref <308>: DATABASE ACCESSION NUMBER: NCBI ACCESSION: NZ_LMKE01000024.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgattgccttcgggtgatagtggcgcacgggtgcgtaacgcgtgggaatctgcccttaggttcggaataacagttagaaatgactgctaataccggatgatgacgttaagtccaaagatttatcgcctagggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgtgatgataatgacagtagcgggagaataagccccggctaactccgtgccagcagccgcggtaatacggagggggctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggaacttggtttttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgtccggacgatttcgagagatcgatttcttcccttcggggactggaacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcaggtacagtgggcagcaatcccgcgagggtgagctaatctccaaaacctgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgaaagggaagcaggcgaccacggtgggttcagcgactggggtgaagtcgtaacaaggtagccgtaggggaacctgcggctggatcacctcctttctaagg

SEQ ID NO: 8604 - DNA, 1497 bp, Sphingomonas sp. Leaf11
  ref <308>: DATABASE ACCESSION NUMBER: NCBI ACCESSION: NZ_LMKG01000001.1
  ref <309>: DATABASE ENTRY DATE: 2019-04-01
  ref <313>: RELEVANT RESIDUES IN SEQ ID NO: (1)..(1497)
tcaaacttgagagtttgatcctggctcagaacgaacgctggcggcatgcctaacacatgcaagtcgaacgatgctttcgggcatagtggcgcacgggtgcgtaacgcgtgggaatctgccccttggttcggaataacagttagaaatgactgctaataccggatgacgacgtaagtccaaagatttatcgccgagggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgtgatgataatgacagtagcgggagaataagccccggctaactccgtgccagcagccgcggtaatacggagggggctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgtccggacgacttcgagagatcgatttcttcccttcggggactggaacacaggtgctgcatggctgtcgtcagctcgtgtcgtgagatgttgggttaagtcccgcaacgagcgcaaccctcgatcttagttaccatcatttagttggggactctaagataaccgccggtgataagccggaggaaggtggggatgacgtcaagtcctcatggcccttacgcgctgggctacacacgtgctacaatggcaggtacagtgggcagcaatcccgcgagggtgagctaatctccaaaacctgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccagcaatgggaagcaggcgaccacggtgggttcagcgactggggtgaagtcgtaacaaggtagccgtaggggaacctgcggctggatcacctcctttctaagg

SEQ ID NO: 8605 - DNA, 1495 bp, Sphingomonas sp. Leaf16
  ref <308>: DATABASE ACCESSION NUMBER: NCBI ACCESSION: NZ_LMKJ01000011.1
  ref <309>: DATABASE ENTRY DATE: 2019-04-01
  ref <313>: RELEVANT RESIDUES IN SEQ ID NO: (1)..(1495)
tcaaacttgagagtttgatcctggctcagaacgaacgctggcggcatgcctaacacatgcaagtcgaacgaaggcttcggccttagtggcgcacgggtgcgtaacgcgtgggaatctgcccttaggttcggaataacagttagaaatgactgctaataccggatgatgacgtaagtccaaagatttatcgcctagggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgtgatgataatgacagtagcgggagaataagccccggctaactccgtgccagcagccgcggtaatacggagggggctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgtccggacgacttcgagagatcgatttcttcccttcggggactggaacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcaggtacagtgggcagcaatcccgcgagggtgagctaatctccaaaacctgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacggtgggttcagcgactggggtgaagtcgtaacaaggtagccgtaggggaacctgcggctggatcacctcctttctaagg

SEQ ID NO: 8606 - DNA, 1500 bp, Sphingomonas sp. Leaf17
  ref <308>: DATABASE ACCESSION NUMBER: NCBI ACCESSION: NZ_LMKL01000001.1
  ref <309>: DATABASE ENTRY DATE: 2019-04-01
  ref <313>: RELEVANT RESIDUES IN SEQ ID NO: (1)..(1500)
aaacttgagagtttgatcatggctcagaatgaacgctggcggcatgcctaacacatgcaagtcgaacgaattaccttcgggtagttagtggcgcacgggtgcgtaacgcgtgggaatctgccccttggttcggaataacagttggaaacgactgctaataccggatgatgacgtaagtccaaagatttatcgccgagggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcctggggctcaaccccagaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggcaggacgacttcgggagaccgatttcttcccttcggggacctgcacacaggtgctgcatggctgtcgtcagctcgtgtcgtgagatgttgggttaagtcccgcaacgagcgcaaccctcgcctttagttaccatcattcagttggggactctaaaggaaccgccggtgataagccggaggaaggtggggatgacgtcaagtcctcatggcccttacgcgctgggctacacacgtgctacaatggcggtgacagtgggcagcaagccagcgatggtgcgctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaactcagcaatgagaggcaggcgaccacggtgggttcagcgactggggtgaagtcgtaacaaggtagccgtaggggaacctgcggctggatcacctcctttctaagga

SEQ ID NO: 8607 - DNA, 1496 bp, Sphingomonas sp. Leaf198
  ref <308>: DATABASE ACCESSION NUMBER: NCBI ACCESSION: NZ_LMPX01000001.1
  ref <309>: DATABASE ENTRY DATE: 2019-04-01
  ref <313>: RELEVANT RESIDUES IN SEQ ID NO: (1)..(1496)
aaacttgagagtttgatcatggctcagaatgaacgctggcggcatgcctaacacatgcaagtcgaacgaaggcttcggccttagtggcgcacgggtgcgtaacgcgtgggaatctgccccttggttcggaataacagttggaaacgactgctaataccggatgatgacgtaagtccaaagatttatcgccgagggatgagcccgcgtaggattaggtagttggtgtggtaaaggcgcaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacaggattagataccctggtagtccacgccgtaaacgatgataactagctgtccggacacttggtgtttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggcaggacgacttccagagatggatttcttcccttcggggacctgcacacaggtgctgcatggctgtcgtcagctcgtgtcgtgagatgttgggttaagtcccgcaacgagcgcaaccctcgcctttagttgccatcatttagttgggcactttaaaggaaccgccggtgataagccggaggaaggtggggatgacgtcaagtcctcatggcccttacgcgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaactcagcaatgagaggcaggcgaccacggtgggtttagcgactggggtgaagtcgtaacaaggtagccgtaggggaacctgcggctggatcacctcctttctaagga

SEQ ID NO: 8608 - DNA, 1498 bp, Sphingomonas sp. Leaf20
  ref <308>: DATABASE ACCESSION NUMBER: NCBI ACCESSION: NZ_LMKN01000001.1
  ref <309>: DATABASE ENTRY DATE: 2019-04-01
  ref <313>: RELEVANT RESIDUES IN SEQ ID NO: (1)..(1498)
aaacttgagagtttgatcatggctcagaatgaacgctggcggcatgcctaacacatgcaagtcgaacgaagtccttcggggcttagtggcgcacgggtgcgtaacgcgtgggaatctgccccttggttcggaataacagttggaaacgactgctaataccggatgatgacgtaagtccaaagatttatcgccgagggatgagcccgcgtaggattaggtagttggtgtggtaaaggcgcaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacaggattagataccctggtagtccacgccgtaaacgatgataactagctgtccggacacttggtgtttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggcaggacgacttccrgagayggatttcttcccttcggggacctgcacacaggtgctgcatggctgtcgtcagctcgtgtcgtgagatgttgggttaagtcccgcaacgagcgcaaccctcgcctttagttgccatcatttagttgggcactttaaaggaaccgccggtgataagccggaggaaggtggggatgacgtcaagtcctcatggcccttacgcgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaactcagcaatgagaggcaggcgaccacggtgggtttagcgactggggtgaagtcgtaacaaggtagccgtaggggaacctgcggctggatcacctcctttctaagga

SEQ ID NO: 8609 - DNA, 1494 bp, Sphingomonas sp. Leaf208
  ref <308>: DATABASE ACCESSION NUMBER: NCBI ACCESSION: NZ_LMKH01000012.1
  ref <309>: DATABASE ENTRY DATE: 2019-04-01
  ref <313>: RELEVANT RESIDUES IN SEQ ID NO: (1)..(1494)
aaacttgagagtttgatcatggctcagaatgaacgctggcggcatgcctaacacatgcaagtcgaacgaaggcttcggccttagtggcgcacgggtgcgtaacgcgtgggaatctaccccttggttcggaataacagttggaaacgactgctaataccggatgatgacgtaagtccaaagatttatcgccgagggatgagcccgcgtaggattaggtagttggtgtggtaaaggcgcaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggcaggacgacttccagagatggatttcttcccttcggggacctgcacacaggtgctgcatggctgtcgtcagctcgtgtcgtgagatgttgggttaagtcccgcaacgagcgcaaccctcgcctttagttgccatcatttagttgggcactttaaaggaaccgccggtgataagccggaggaaggtggggatgacgtcaagtcctcatggcccttacgcgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaactcgcaagagaggcaggcgaccacggtgggtttagcgactggggtgaagtcgtaacaaggtagccgtaggggaacctgcggctggatcacctcctttctaagga

SEQ ID NO: 8610 - DNA, 1496 bp, Sphingomonas sp. Leaf22
  ref <308>: DATABASE ACCESSION NUMBER: NCBI ACCESSION: NZ_LMKP01000012.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcctaacacatgcaagtcgaacgatgctttcgggcatagtggcgcacgggtgcgtaacgcgtgggaatctgcccttgggttcggaataacagttagaaatgactgctaataccggatgatgtcgataagaccaaagatttatcgcctgaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgtgatgataatgacagtagcgggagaataagccccggctaactccgtgccagcagccgcggtaatacggagggggctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgtccggacgacttcgagagatcgatttcttcccttcggggactggaacacaggtgctgcatggctgtcgtcagctcgtgtcgtgagatgttgggttaagtcccgcaacgagcgcaaccctcgatcctagttaccatcatttagttgggtactttaggataaccgccggtgataagccggaggaaggtggggatgacgtcaagtcctcatggcccttacgcgctgggctacacacgtgctacaatggcaggtacagtgggcagcaatcccgcgagggtgagctaatctccaaaacctgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgtaagggaagcaggcgaccacggtgggttcagcgactggggtgaagtcgtaacaaggtagccgtaggggaacctgcggctggatcacctcctttctaagg

SEQ ID NO: 8611 - DNA, 1494 bp, Sphingomonas sp. Leaf226
  ref <308>: DATABASE ACCESSION NUMBER: NCBI ACCESSION: NZ_LMKT01000001.1
  ref <309>: DATABASE ENTRY DATE: 2019-04-01
  ref <313>: RELEVANT RESIDUES IN SEQ ID NO: (1)..(1494)
aaacttgagagtttgatcatggctcagaatgaacgctggcggcatgcctaacacatgcaagtcgaacgaagccttcgggtttagtggcgcacgggtgcgtaacgcgtgggaatctgccccttggttcggaataacagttggaaacgactgctaataccggatgatgacgtaagtccaaagatttatcgccgagggatgagcccgcgtaggattaggtagttggtgtggtaaaggcgcaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaycagtggcgaaggcggctgactggacatgtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggcaggacgacttccagagatggatttcttcccttcggggacctgcacacaggtgctgcatggctgtcgtcagctcgtgtcgtgagatgttgggttaagtcccgcaacgagcgcaaccctcgaccttagttgccatcatttagttgggcactttaaggtaaccgccggtgataagccggaggaaggtggggatgacgtcaagtcctcatggcccttacgcgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaactcgcaagagaggcaggcgaccacggtgggtttagcgactggggtgaagtcgtaacaaggtagccgtaggggaacctgcggctggatcacctcctttctaagga

SEQ ID NO: 8612 - DNA, 1497 bp, Sphingomonas sp. Leaf23; identical to SEQ ID NO: 8604
  ref <308>: DATABASE ACCESSION NUMBER: NCBI ACCESSION: NZ_LMKR01000002.1
  ref <309>: DATABASE ENTRY DATE: 2019-04-01
  ref <313>: RELEVANT RESIDUES IN SEQ ID NO: (1)..(1497)

SEQ ID NO: 8613 - DNA, 1494 bp, Sphingomonas sp. Leaf230
  ref <308>: DATABASE ACCESSION NUMBER: NCBI ACCESSION: NZ_LMKW01000008.1
  ref <309>: DATABASE ENTRY DATE: 2019-04-01
  ref <313>: RELEVANT RESIDUES IN SEQ ID NO: (1)..(1494)
aaacttgagagtttgatcatggctcagaatgaacgctggcggcatgcctaacacatgcaagtcgaacgaaggcttcggccttagtggcgcacgggtgcgtaacgcgtgggaatctgccccttggttcggaataacagttggaaacgactgctaataccggatgatgacgtaagtccaaagatttatcgccgagggatgagcccgcgtaggattaggtagttggtgtggtaaaggcgcaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacaggattagataccctggtagtccacgccgtaaacgatgataactagctgtccggacacttggtgtttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggcaggacgacttccagagatggatttcttcccttcggggacctgcacacaggtgctgcatggctgtcgtcagctcgtgtcgtgagatgttgggttaagtcccgcaacgagcgcaaccctcgcctttagttgccatcatttagttgggcactttaaaggaaccgccggtgataagccggaggaaggtggggatgacgtcaagtcctcatggcccttacgcgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaactcgtaagagaggcaggcgaccacggtgggtttagcgactggggtgaagtcgtaacaaggtagccgtaggggaacctgcggctggatcacctcctttctaagga

SEQ ID NO: 8614 - DNA, 1498 bp, Sphingomonas sp. Leaf231
  ref <308>: DATABASE ACCESSION NUMBER: NCBI ACCESSION: NZ_LMLS01000001.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgatgctttcgggcatagtggcgcacgggtgcgtaacgcgtgggaatctgcccttgggttcgggataacagcgggaaactgctgctaataccggatgatatcgcgagatcaaagatttatcgcccgaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggctttgtaagtcaggggtgaaagcctggagctcaactccagaactgcctttgagactgcatcgcttgaatccgggagaggtaagtggaattccgagtgtagaggtgaaattcgtagatattcggaagaacaccagtggcgaaggcggcttactggaccggaattgacgctgaggtgcgaaagcgtggggagcaaacaggattagataccctggtagtccacgccgtaaacgatgataactagctgtccgggaacttagtttttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcattaagttgggtactttaaaggaaccgccggtgataagccggaggaaggtggggatgacgtcaagtcctcatggcccttacgcgctgggctacacacgtgctacaatggcgactacagtgggctgcaatcccgcgagggtgagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaacctcgcaagaggaggcaggcgaccacggtgggcttagcgactggggtgaagtcgtaacaaggtagccgtaggggaacctgcggctggatcacctcctttctaagga

SEQ ID NO: 8615 - DNA, 1496 bp, Sphingomonas sp. Leaf24
  ref <308>: DATABASE ACCESSION NUMBER: NCBI ACCESSION: NZ_LMKS01000001.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcctaacacatgcaagtcgaacgatgctttcgggcatagtggcgcacgggtgcgtaacgcgtgggaatctgcccttgggttcggaataacagttagaaatgactgctaataccggatgatgtcgataagaccaaagatttatcgcctgaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgtgatgataatgacagtagcgggagaataagccccggctaactccgtgccagcagccgcggtaatacggagggggctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggaacttggtttttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgtccggacgacttcgagagatcgatttcttcccttcggggactggaacacaggtgctgcatggctgtcgtcagctcgtgtcgtgagatgttgggttaagtcccgcaacgagcgcaaccctcgatcttagttaccatcatttagttggggactctaagataaccgccggtgataagccggaggaaggtggggatgacgtcaagtcctcatggcccttacgcgctgggctacacacgtgctacaatggcaggtacagtgggcagcaatcccgcgagggtgagctaatctccaaaacctgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacggtgggttcagcgactggggtgaagtcgtaacaaggtagccgtaggggaacctgcggctggatcacctcctttctaagg

SEQ ID NO: 8616 - DNA, 1500 bp, Sphingomonas sp. Leaf242
  ref <308>: DATABASE ACCESSION NUMBER: NCBI ACCESSION: NZ_LMLW01000008.1
  ref <309>: DATABASE ENTRY DATE: 2019-04-01
  ref <313>: RELEVANT RESIDUES IN SEQ ID NO: (1)..(1500)
aaacttgagagtttgatcatggctcagaatgaacgctggcggcatgcctaacacatgcaagtcgaacgaattaccttcgggtagttagtggcgcacgggtgcgtaacgcgtgggaatctgccccttggttcggaataacagttggaaacgactgctaataccggatgacgacgtaagtccaaagatttatcgccgagggatgagcccgcgtaggattaggtagttggtgtggtaaaggcgcaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacaggattagataccctggtagtccacgccgtaaacgatgataactagctgtccggacacttggtgtttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggcaggacgacttccagagatggatttcttcccttcggggacctgcacacaggtgctgcatggctgtcgtcagctcgtgtcgtgagatgttgggttaagtcccgcaacgagcgcaaccctcgcctttagttgccatcatttagttgggcactttaaaggaaccgccggtgataagccggaggaaggtggggatgacgtcaagtcctcatggcccttacgcgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaactcagcaatgagaggcaggcgaccacggtgggtttagcgactggggtgaagtcgtaacaaggtagccgtaggggaacctgcggctggatcacctcctttctaagga

SEQ ID NO: 8617 - DNA, 1497 bp, Sphingomonas sp. Leaf25
  ref <308>: DATABASE ACCESSION NUMBER: NCBI ACCESSION: NZ_LMKU01000019.1
  ref <309>: DATABASE ENTRY DATE: 2019-04-01
  ref <313>: RELEVANT RESIDUES IN SEQ ID NO: (1)..(1497)
tcaaacttgagagtttgatcctggctcagaacgaacgctggcggcatgcctaacacatgcaagtcgaacgatgctttcgggcatagtggcgcacgggtgcgtaacgcgtgggaatctgccctttggttcggaataacagttagaaatgactgctaataccggatgatgacgtaagtccaaagatttatcgccagaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgtgatgataatgacagtagcgggagaataagccccggctaactccgtgccagcagccgcggtaatacggagggggctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgtccggacgacttcgagagatcgatttcttcccttcggggactggaacacaggtgctgcatggctgtcgtcagctcgtgtcgtgagatgttgggttaagtcccgcaacgagcgcaaccctcgatcttagttaccatcatttagttggggactctaagataaccgccggtgataagccggaggaaggtggggatgacgtcaagtcctcatggcccttacgcgctgggctacacacgtgctacaatggcgactacagtgggcagcaatcccgcgagggtgagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccagcaatgggaagcaggcgaccacggtgggttcagcgactggggtgaagtcgtaacaaggtagccgtaggggaacctgcggctggatcacctcctttctaagg

SEQ ID NO: 8618 - DNA, 1498 bp, Sphingomonas sp. Leaf257
  ref <308>: DATABASE ACCESSION NUMBER: NCBI ACCESSION: NZ_LMMH01000023.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgaggcccttcggggtttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgactggcagagatgcctttcttcccttcggggactggaacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgtaagggaagcaggcgaccacggtgggttcagcgactggggtgaagtcgtaacaaggtagccgtaggggaacctgcggctggatcacctcctttctaagga

SEQ ID NO: 8619 - DNA, 1494 bp, Sphingomonas sp. Leaf28
  ref <308>: DATABASE ACCESSION NUMBER: NCBI ACCESSION: NZ_LMKX01000007.1
  ref <309>: DATABASE ENTRY DATE: 2019-04-01
  ref <313>: RELEVANT RESIDUES IN SEQ ID NO: (1)..(1494)
aaacttgagagtttgatcatggctcagaatgaacgctggcggcatgcctaacacatgcaagtcgaacgaaggcttcggccttagtggcgcacgggtgcgtaacgcgtgggaatctgccccttggttcggaataacagttggaaacgactgctaataccggatgaygacgtaagtccaaagatttatcgccgagggatgagcccgcgtaggattaggtagttggtgtggtaaaggcgcaccaagccgacgatccttagctggtctgagaggatgatcagccacactgggactgagacacggcccagactcctacgggaggcagcagtggggaatattggacaatgggcgmaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacaggattagataccctggtagtccacgccgtaaacgatgataactagctgtccggrsacttggtstttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggcaggacgacttccrgagayggatttcttcccttcggggacctgcacacaggtgctgcatggctgtcgtcagctcgtgtcgtgagatgttgggttaagtcccgcaacgagcgcaaccctcgcctttagttgccatcatttagttgggcactttaaaggaaccgccggtgataagccggaggaaggtggggatgacgtcaagtcctcatggcccttacgcgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaactcgcaagagaggcaggcgaccacggtgggtttagcgactggggtgaagtcgtaacaaggtagccgtaggggaacctgcggctggatcacctcctttctaagga

SEQ ID NO: 8620 - DNA, 1495 bp, Sphingomonas sp. Leaf29; identical to SEQ ID NO: 8605
  ref <308>: DATABASE ACCESSION NUMBER: NCBI ACCESSION: NZ_LMKY01000008.1
  ref <309>: DATABASE ENTRY DATE: 2019-04-01
  ref <313>: RELEVANT RESIDUES IN SEQ ID NO: (1)..(1495)

SEQ ID NO: 8621 - DNA, 1494 bp, Sphingomonas sp. Leaf30; identical to SEQ ID NO: 8592
  ref <308>: DATABASE ACCESSION NUMBER: NCBI ACCESSION: NZ_LMKZ01000007.1
  ref <309>: DATABASE ENTRY DATE: 2019-04-01
  ref <313>: RELEVANT RESIDUES IN SEQ ID NO: (1)..(1494)

SEQ ID NO: 8622 - DNA, 1495 bp, Sphingomonas sp. Leaf32; identical to SEQ ID NO: 8605
  ref <308>: DATABASE ACCESSION NUMBER: NCBI ACCESSION: NZ_LMLA01000008.1
  ref <309>: DATABASE ENTRY DATE: 2019-04-01
  ref <313>: RELEVANT RESIDUES IN SEQ ID NO: (1)..(1495)

SEQ ID NO: 8623 - DNA, 1496 bp, Sphingomonas sp. Leaf339
  ref <308>: DATABASE ACCESSION NUMBER: NCBI ACCESSION: NZ_LMRS01000001.1
  ref <309>: DATABASE ENTRY DATE: 2019-04-01
  ref <313>: RELEVANT RESIDUES IN SEQ ID NO: (1)..(1496)
aaacttgagagtttgatcatggctcagaatgaacgctggcggcatgcctaacacatgcaagtcgaacgagaccttcgggtctagtggcgcacgggtgcgtaacgcgtgggaatctgccccttggttcggaataacagttggaaacgactgctaataccggatgatgacgtaagtccaaagatttatcgccgagggatgagcccgcgtaggattaggtagttggtgtggtaaaggcgcaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagttagaggtgaaagcccagagctcaactctggaattgcctttgatactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcattcagttggggactctaaaggaaccgccggtgataagccggaggaaggtggggatgacgtcaagtcctcatggcccttacgcgctgggctacacacgtgctacaatggcggtgacagtgggcagcaaaccggcgacggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaacctcgcaagaggaggcaggcgaccacggtgggcttagcgactggggtgaagtcgtaacaaggtagccgtaggggaacctgcggctggatcacctcctttctaagga

SEQ ID NO: 8624 - DNA, 1496 bp, Sphingomonas sp. Leaf34
  ref <308>: DATABASE ACCESSION NUMBER: NCBI ACCESSION: NZ_LMLC01000001.1
  ref <309>: DATABASE ENTRY DATE: 2019-04-01
  ref <313>: RELEVANT RESIDUES IN SEQ ID NO: (1)..(1496)
aaacttgagagtttgatcatggctcagaatgaacgctggcggcatgcctaacacatgcaagtcgaacgaagscttcggcyttagtggcgcacgggtgcgtaacgcgtgggaatctgccccttggttcggaataacagttggaaacgactgctaataccggatgatgacgtaagtccaaagatttatcgccgagggatgagcccgcgtaggattaggtagttggtgtggtaaaggcgcaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacaggattagataccctggtagtccacgccgtaaacgatgataactagctgtccggacacttggtgtttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggcaggacgacttccggagacggatttcttcccttcggggacctgcacacaggtgctgcatggctgtcgtcagctcgtgtcgtgagatgttgggttaagtcccgcaacgagcgcaaccctcgaccttagttgccatcattcagttgggcactttaaggtaaccgccggtgataagccggaggaaggtggggatgacgtcaagtcctcatggcccttacgcgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaactcagcaatgagaggcaggcgaccacggtgggtttagcgactggggtgaagtcgtaacaaggtagccgtaggggaacctgcggctggatcacctcctttctaagga

SEQ ID NO: 8625 - DNA, 1499 bp, Sphingomonas sp. Leaf343
  ref <308>: DATABASE ACCESSION NUMBER: NCBI ACCESSION: NZ_LMPG01000001.1
  ref <309>: DATABASE ENTRY DATE: 2019-04-01
  ref <313>: RELEVANT RESIDUES IN SEQ ID NO: (1)..(1499)
aaacttgagagtttgatcatggctcagaacgaacgctggcggcatgcctaacacatgcaagtcgaacgagacctttcggggtctagtggcgcacgggtgcgtaacgcgtgggaatctgccctcaggttcggaataacagttggaaacgactgctaataccggatgacgacgttaagtccaaagatttatcgcctgaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagttagaggtgaaagcctggagctcaactccagaattgcctttgatactgcatggcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgaccttagttgccatcatttagttgggcactttaaggtaaccgccggtgataagccggaggaaggtggggatgacgtcaagtcctcatggcccttacgcgctgggctacacacgtgctacaatggcggtgacagtgggcagcaaactcgcgagagtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcagcaatgagaggcaggcgaccacggtgggcttagcgactggggtgaagtcgtaacaaggtagccgtaggggaacctgcggctggatcacctcctttctaagga

SEQ ID NO: 8626 - DNA, 1494 bp, Sphingomonas sp. Leaf357
  ref <308>: DATABASE ACCESSION NUMBER: NCBI ACCESSION: NZ_LMPM01000001.1
  ref <309>: DATABASE ENTRY DATE: 2019-04-01
  ref <313>: RELEVANT RESIDUES IN SEQ ID NO: (1)..(1494)
aaacttgagagtttgatcatggctcagaatgaacgctggcggcatgcctaacacatgcaagtcgaacgagatcttcggatctagtggcgcacgggtgcgtaacgcgtgggaatctaccccttggttcggaataacagttggaaacgactgctaataccggatgatgacgtaagtccaaagatttatcgccgagggatgagcccgcgtaggattaggtagttggtgtggtaaaggcgcaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcctggtgctcaacaccagaactgccttttagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcggggttcttagaacttcggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgcctagtatattttccggagacggattatttcagttcggctggctagtgcacaggtgctgcatggctgtcgtcagctcgtgtcgtgagatgttgggttaagtcccgcaacgagcgcaaccctcgtctttagttgccatcatttagttgggcactctaaagaaaccgccggtgataagccggaggaaggtggggatgacgtcaagtcctcatggcccttacgcgctgggctacacacgtgctacaatggcggtgacagtgggcagcaatcccgcaagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcgtaacaaggtagccgtaggggaacctgcggctggatcacctcctttctaagga

SEQ ID NO: 8627 - DNA, 1414 bp, Sphingomonas sp. Leaf38
  ref <308>: DATABASE ACCESSION NUMBER: NCBI ACCESSION: NZ_LMLD01000006.1
  ref <309>: DATABASE ENTRY DATE: 2019-04-01
  ref <313>: RELEVANT RESIDUES IN SEQ ID NO: (1)..(1414)
ttagtggcgcacgggtgcgtaacgcgtgggaatctgccccttggttcggaataacagttggaaacgactgctaataccggatgatgacgtaagtccaaagatttatcgccgagggatgagcccgcgtaggattaggtagttggtgtggtaaaggcgcaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacaggattagataccctggtagtccacgccgtaaacgatgataactagctgtccggacacttggtgtttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggcaggacgacttccggagacggatttcttcccttcggggacctgcacacaggtgctgcatggctgtcgtcagctcgtgtcgtgagatgttgggttaagtcccgcaacgagcgcaaccctcgaccttagttgccatcattcagttgggcactttaaggtaaccgccggtgataagccggaggaaggtggggatgacgtcaagtcctcatggcccttacgcgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaactcgcaagagaggcaggcgaccacggtgggtttagcgactggggtgaagtcgtaacaaggtagccgtaggggaacctgcggctggatcacctcctttctaagga

SEQ ID NO: 8628 - DNA, 1497 bp, Sphingomonas sp. Leaf407; identical to SEQ ID NO: 8617
  ref <308>: DATABASE ACCESSION NUMBER: NCBI ACCESSION: NZ_LMQO01000001.1
  ref <309>: DATABASE ENTRY DATE: 2019-04-01
  ref <313>: RELEVANT RESIDUES IN SEQ ID NO: (1)..(1497)

SEQ ID NO: 8629 - DNA, 1494 bp, Sphingomonas sp. Leaf412
  ref <308>: DATABASE ACCESSION NUMBER: NCBI ACCESSION: NZ_LMQP01000001.1
  ref <309>: DATABASE ENTRY DATE: 2019-04-01
  ref <313>: RELEVANT RESIDUES IN SEQ ID NO: (1)..(1494)
aaacttgagagtttgatcatggctcagaatgaacgctggcggcatgcctaacacatgcaagtcgaacgaagccttcgggcttagtggcgcacgggtgcgtaacgcgtgggaatctgcccttgggttcggaataacagttggaaacgactgctaataccggatgatgacgtaagtccaaagatttatcgcccagggatgagcccgcgtaggattagctagttggtgaggtaaaggctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggatgataatgacagtaccgggagaataagccccggctaactccgtgccagcagccgcggtaatacggagggggctagcgttattcggaattactgggcgtaaagcgcacgtaggcggctttgtaagtcagaggtgaaagcctggagctcaactccagaactgcctttgagactgcatcgctcgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacctggtgcttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcattcagttgggtactctaaaggaaccgccggtgataagccggaggaaggtggggatgacgtcaagtcctcatggcccttacgcgctgggctacacacgtgctacaatggcgactacagtgggcagcaatcctgcgagggtgagctaatctccaaaagtcgtctcagttcggattgcactctgcaactcgagtgcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaagga

SEQ ID NO: 8630 - DNA, 1497 bp, Sphingomonas sp. Leaf42; identical to SEQ ID NO: 8617
  ref <308>: DATABASE ACCESSION NUMBER: NCBI ACCESSION: NZ_LMLF01000001.1
  ref <309>: DATABASE ENTRY DATE: 2019-04-01
  ref <313>: RELEVANT RESIDUES IN SEQ ID NO: (1)..(1497)

SEQ ID NO: 8631 - DNA, 1496 bp, Sphingomonas sp. Leaf5; identical to SEQ ID NO: 8615
  ref <308>: DATABASE ACCESSION NUMBER: NCBI ACCESSION: NZ_LMJZ01000001.1
  ref <309>: DATABASE ENTRY DATE: 2019-04-01
  ref <313>: RELEVANT RESIDUES IN SEQ ID NO: (1)..(1496)

SEQ ID NO: 8632 - DNA, 1496 bp, Sphingomonas sp. Leaf62; identical to SEQ ID NO: 8610
  ref <308>: DATABASE ACCESSION NUMBER: NCBI ACCESSION: NZ_LMLN01000018.1
  ref <309>: DATABASE ENTRY DATE: 2019-04-01
  ref <313>: RELEVANT RESIDUES IN SEQ ID NO: (1)..(1496)

SEQ ID NO: 8633 - DNA, 1459 bp, Sphingomonas sp. Leaf67
  ref <308>: DATABASE ACCESSION NUMBER: NCBI ACCESSION: NZ_LMLP01000007.1
  ref <309>: DATABASE ENTRY DATE: 2019-04-01
  ref <313>: RELEVANT RESIDUES IN SEQ ID NO: (1)..(1459)
ccgggggcatgcctaacacatgcaagtcgaacgatgctttcgggcatagtggcgcacgggtgcgtaacgcgtgggaatctgcccttgggttcggaataacagttagaaatgactgctaataccggatgatgtcgataagaccaaagatttatcgcctgaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgtgatgataatgacagtagcgggagaataagccccggctaactccgtgccagcagccgcggtaatacggagggggctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgtccggacgacttcgagagatcgatttcttcccttcggggactggaacacaggtgctgcatggctgtcgtcagctcgtgtcgtgagatgttgggttaagtcccgcaacgagcgcaaccctcgatcctagttaccatcattaagttgggtactttaggataaccgccggtgataagccggaggaaggtggggatgacgtcaagtcctcatggcccttacgcgctgggctacacacgtgctacaatggcaggtacagtgggcagcaatcccgcgagggtgagctaatctccaaaacctgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgtaagggaagcaggcgaccacggtgggttcagcgactggggtgaagtcgtaacaaggtagccgtaggggaacctgcggctggatcacctcctttctaagg

SEQ ID NO: 8634 - DNA, 1497 bp, Sphingomonas sp. Leaf9; identical to SEQ ID NO: 8604
  ref <308>: DATABASE ACCESSION NUMBER: NCBI ACCESSION: NZ_LMKC01000001.1
  ref <309>: DATABASE ENTRY DATE: 2019-04-01
  ref <313>: RELEVANT RESIDUES IN SEQ ID NO: (1)..(1497)

SEQ ID NO: 8635 - DNA, 1497 bp, Sphingomonas sp. MM-1
  ref <308>: DATABASE ACCESSION NUMBER: NCBI ACCESSION: NC_020561.1
  ref <309>: DATABASE ENTRY DATE: 2019-04-01
  ref <313>: RELEVANT RESIDUES IN SEQ ID NO: (1)..(1497)
tcaacttgagagtttgattctggctcagaacgaacgctggcggcatgcctaacacatgcaagtcgaacgaaggcttcggccttagtggcgcacgggtgcgtaacgcgtgggaatctgccctttggtacggaataacagtgagaaattactgctaataccgtatgatgtcgcgagaccaaagatttatcgccaaaggatgagcccgcgtaggattagctagttggtggggtaaaggcccaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggcttggtaagttagaggtgaaagcccggagctcaactccggaatagcctttaagactgcctcgcttgaacgtcggagaggtgagtggaattccgagtgtagaggtgaaattcgtagatattcggaagaacaccagtggcgaaggcggctcactggacgactgttgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaagaaattgacgggggcctgcacaagcggtggagcatgtggtttaattcgaagcaacgcgcagaaccttaccaacgtttgacatccctatcgcggttagtggagacactttccttcagttcggctggataggtgacaggtgctgcatggctgtcgtcagctcgtgtcgtgagatgttgggttaagtcccgcaacgagcgcaaccctcgcctttagttgccatcattaagttgggcactctaaaggaaccgccggtgataagccggaggaaggtggggatgacgtcaagtcctcatggcccttacgcgttgggctacacacgtgctacaatggcaactacagtgggcagcgaactcgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaacccgtaagggaggcaggcgaccacggtgggtttagcgactggggtgaagtcgtaacaaggtagccgtaggggaacctgcggctggatcacctcctttctaagga

SEQ ID NO: 8636 - DNA, 1494 bp, Sphingomonas sp. Mn802worker
  ref <308>: DATABASE ACCESSION NUMBER: NCBI ACCESSION: NZ_AORY01000018.1
  ref <309>: DATABASE ENTRY DATE: 2019-04-01
  ref <313>: RELEVANT RESIDUES IN SEQ ID NO: (1)..(1494)
tcaaacttgagagtttgatcctggctcagaacgaacgctggcggcatgcctaacacatgcaagtcgaacgatgctttcgggcatagtggcgcacgggtgcgtaacgcgtgggaatctgccctttggttcggaataacagttggaaacgactgctaataccggatgatgacgtaagtccaaagatttatcgccagaggatgagcccgcgtgagattaggtagttggtggggtaaaggcctaccaagccgacgatctctagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggctttgtaagttaggggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatttcttcccttcggggactggaacacaggtgctgcatggctgtcgtcagctcgtgtcgtgagatgttgggttaagtcccgcaacgagcgcaaccctcgcctttagttaccatcattcagttgggtactctagaggaaccgccggtgataagccggaggaaggtggggatgacgtcaagtcctcatggcccttacgcgctgggctacacacgtgctacaatggcggtgacagtgggcagcaatcccgcgagggtgagctaatctccaaaagccgtctcagttcggatcgttctctgcaactcgagagcgtgaaggcggaatcgctagtaatcgcggatcagcatgccgcggtgaatacgttcccaggccttgtacacaccgcccgtcacaccatgggagttggtttcacccgaaggcgttgcgctgaccgcaaggaggcaggcgaccacggtgggatcagcgactggggtgaagtcgtaacaaggtagccgtaggggaacctgcggctggatcacctcctttctaagga

SEQ ID NO: 8637 - DNA, 1494 bp, Sphingomonas sp. NIC1
  ref <308>: DATABASE ACCESSION NUMBER: NCBI ACCESSION: NZ_CP015521.1
  ref <309>: DATABASE ENTRY DATE: 2019-04-01
  ref <313>: RELEVANT RESIDUES IN SEQ ID NO: (1)..(1494)
aaacttgagagtttgatcatggctcagaacgaacgctggcggcatgcctaacacatgcaagtcgaacgagatcttcgggtctagtggcgcacgggtgcgtaacgcgtgggaatctgccctttggttcggaataacagttggaaacgactgctaataccggatgatgacgaaagtccaaagatttatcgccagaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttagttggggactctaaaggaaccgccggtgataagccggaggaaggtggggatgacgtcaagtcctcatggcccttacgcgctgggctacacacgtgctacaatggcggtgacagtgggcagcaaactcgcgagagtgcgctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaagga

SEQ ID NO: 8638 - DNA, 1495 bp, Sphingomonas sp. Ndbn-20
  ref <308>: DATABASE ACCESSION NUMBER: NCBI ACCESSION: NZ_LGVA01000084.1
  ref <309>: DATABASE ENTRY DATE: 2019-04-01
  ref <313>: RELEVANT RESIDUES IN SEQ ID NO: (1)..(1495)
tcaacttgagagtttgattctggctcagaacgaacgctggcggcatgcctaacacatgcaagtcgaacgaacctttcggggttagtggcgcacgggtgcgtaacgcgtgggaatctgccttcaggtacggaataactcatggaaacgtgtgctaataccgtatgatgtctacggaccaaagatttatcgcctggagatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagttagaggtgaaagcccggggctcaaccccggaactgcctttaagactgcatcgcttgaacgtcggagaggtgagtggaattccgagtgtagaggtgaaattcgtagatattcggaagaacaccagtggcgaaggcggctcactggacgactgttgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaagaaattgacgggggcctgcacaagcggtggagcatgtggtttaattcgaagcaacgcgcagaaccttaccaacgtttgacatccctagtatggattttggagacaatttccttcagttcggctggctaggtgacaggtgctgcatggctgtcgtcagctcgtgtcgtgagatgttgggttaagtcccgcaacgagcgcaaccctcgcctttagttgccatcatttagttgggtactctaaaggaaccgccggtgataagccggaggaaggtggggatgacgtcaagtcctcatggcccttacgcgttgggctacacacgtgctacaatggcaactacagtgggcagcgaactcgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaaccgcaaggaggcaggcgaccacggtgggtttagcgactggggtgaagtcgtaacaaggtagccgtaggggaacctgcggctggatcacctcctttctaagga

SEQ ID NO: 8639 - DNA, 1493 bp, Sphingomonas sp. PAMC 26605
  ref <308>: DATABASE ACCESSION NUMBER: NCBI ACCESSION: NZ_JH584249.1
  ref <309>: DATABASE ENTRY DATE: 2019-04-01
  ref <313>: RELEVANT RESIDUES IN SEQ ID NO: (1)..(1493)
taaacttgagagtttgatcatggctcagaatgaacgctggcggcatgcctaacacatgcaagtcgaacgaaggcttcggccttagtggcgcacgggtgcgtaacgcgtgggaatctacccttaggttcggaataacagttggaaacgactgctaataccggatgatgacgtaagtccaaagatttatcgcctagggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcctggtgctcaacaccagaactgccttttagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcggggctcttagagcttcggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttcgggagaccgatctcttcccttcggggactggaacacaggtgctgcatggctgtcgtcagctcgtgtcgtgagatgttgggttaagtcccgcaacgagcgcaaccctcgcctttagttaccatcattcagttggggactctaaaggaaccgccggtgataagccggaggaaggtggggatgacgtcaagtcctcatggcccttacgcgctgggctacacacgtgctacaatggcggtgacagtgggcagcaatcccgcaagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcgtaacaaggtagccgtaggggaacctgcggctggatcacctcctttctaagga

SEQ ID NO: 8640 - DNA, 1494 bp, Sphingomonas sp. PAMC 26621
  ref <308>: DATABASE ACCESSION NUMBER: NCBI ACCESSION: NZ_AIDW01000026.1
  ref <309>: DATABASE ENTRY DATE: 2019-04-01
  ref <313>: RELEVANT RESIDUES IN SEQ ID NO: (1)..(1494)
taaacttgagagtttgatcatggctcagaatgaacgctggcggcatgcctaacacatgcaagtcgaacgaaggcttcggccttagtggcgcacgggtgcgtaacgcgtgggaatctgcccctggttcggaataacagttggaaacgactgctaataccggatgatgacgtaagtccaaagatttatcgccgagggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcggggctacttagagcttcggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcctttgacactgtccggacgatttcgggagaccgatctcttcccttcggggactggaacacaggtgctgcatggctgtcgtcagctcgtgtcgtgagatgttgggttaagtcccgcaacgagcgcaaccctcgcctttagttaccatcattcagttggggactctaaaggaaccgccggtgataagccggaggaaggtggggatgacgtcaagtcctcatggcccttacgcgctgggctacacacgtgctacaatggcggtgacagtgggcagcaatcccgcaagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcgtaacaaggtagccgtaggggaacctgcggctggatcacctcctttctaagga

SEQ ID NO: 8641 - DNA, 1492 bp, Sphingomonas sp. PP-CC-1A-547; identical to SEQ ID NO: 8538
  ref <308>: DATABASE ACCESSION NUMBER: NCBI ACCESSION: NZ_RAPZ01000007.1
  ref <309>: DATABASE ENTRY DATE: 2019-04-01
  ref <313>: RELEVANT RESIDUES IN SEQ ID NO: (1)..(1492)

SEQ ID NO: 8642 - DNA, 1496 bp, Sphingomonas sp. PP-CE-3A-406
  ref <308>: DATABASE ACCESSION NUMBER: NCBI ACCESSION: NZ_RCWY01000005.1
  ref <309>: DATABASE ENTRY DATE: 2019-04-01
  ref <313>: RELEVANT RESIDUES IN SEQ ID NO: (1)..(1496)
aaacttgagagtttgatcatggctcagaatgaacgctggcggcatgcctaacacatgcaagtcgaacgaattaccttcgggtagttagtggcgcacgggtgcgtaacgcgtgggaatctgccccttggttcggaataacagttggaaacgactgctaataccggatgatgacgtaagtccaaagatttatcgccgagggatgagcccgcgtaggattaggtagttggtgtggtaaaggcgcaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacaggattagataccctggtagtccacgccgtaaacgatgataactagctgtccggacacttggtgtttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggcaggacgacttccagagatggatttcttcccttcggggacctgcacacaggtgctgcatggctgtcgtcagctcgtgtcgtgagatgttgggttaagtcccgcaacgagcgcaaccctcgcctttagttgccatcatttagttgggcactttaaaggaaccgccggtgataagccggaggaaggtggggatgacgtcaagtcctcatggcccttacgcgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaactcgtaagagaggcaggcgaccacggtgggtttagcgactggggtgaagtcgtaacaaggtagccgtaggggaacctgcggctggatcacctcctttctaag

SEQ ID NO: 8643 - DNA, 1492 bp, Sphingomonas sp. PP-F2F-G114-C0414; identical to SEQ ID NO: 8538
  ref <308>: DATABASE ACCESSION NUMBER: NCBI ACCESSION: NZ_RCWT01000006.1
  ref <309>: DATABASE ENTRY DATE: 2019-04-01
  ref <313>: RELEVANT RESIDUES IN SEQ ID NO: (1)..(1492)

SEQ ID NO: 8644 - DNA, 1491 bp, Sphingomonas sp. PR090111-T3T-6A
  ref <308>: DATABASE ACCESSION NUMBER: NCBI ACCESSION: NZ_AORL01000003.1
  ref <309>: DATABASE ENTRY DATE: 2019-04-01
  ref <313>: RELEVANT RESIDUES IN SEQ ID NO: (1)..(1491)
aacatgagagtttgattctggctcagaacgaacgctggcggcatgcctaacacatgcaagtcgaacgagatcttcggatctagtggcgcacgggtgcgtaacgcgtgggaatctgccttggggtacggaataactcagagaaatttgagctaataccgtatgatgtcttcggaccaaagatttatcgccctgagatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggggaaaccctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggcttggtaagttagaggtgaaagcctggagctcaactccagaattgcctttaagactgccgagctagcaggtgagagaggtgagtggaattccgagtgtagaggtgaaattcgtagatattcggaagaacaccagtggcgaaggcggctcactggctcatactggacgctgaggtgcgaaagcgtggggagcaaacaggattagataccctggtagtccacgccgtaaacgatgaagactagctgtccgggcacatggtgcttgggtggcgcagctaacgcattaagtcttccgcctggggagtacggccgcaaggttaaaactcaaagaaattgacgggggcctgcacaagcggtggagcatgtggtttaattcgaagcaacgcgcagaaccttaccagcgtttgacatggtaggacgactggcagagatgcctttcttcccttcggggacctatacacaggtgctgcatggctgtcgtcagctcgtgtcgtgagatgttgggttaagtcccgcaacgagcgcaaccctcgcctttagttaccatcattcagttggggactctaaaggaaccgccggtgataagccggaggaaggtggggatgacgtcaagtcctcatggcccttacgcgctgggctacacacgtgctacaatggcgactacagtgggctgcgaactcgcgagggtgagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgtcgcgctaaccgcaaggaggcaggcgaccacggtgggtttagcgactggggtgaagtcgtaacaaggtagccgtaggggaacctgcggctggatcacctcctttctaagga

SEQ ID NO: 8645 - DNA, 1494 bp, Sphingomonas sp. RIT328
  ref <308>: DATABASE ACCESSION NUMBER: NCBI ACCESSION: NZ_JFYV01000047.1
  ref <309>: DATABASE ENTRY DATE: 2019-04-01
  ref <313>: RELEVANT RESIDUES IN SEQ ID NO: (1)..(1494)
aaacttgagagtttgatcatggctcagaacgaacgctggcggcatgcctaacacatgcaagtcgaacgaaggcttcggccttagtggcgcacgggtgcgtaacgcgtgggaatctgcccttaggttcggaataacagttggaaacgactgctaataccggatgatgacgtaagtccaaagatttatcgcctgaggatgagcccgcgtaggattagctagttggtgtggtaagagcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggaacttggtttttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacggttggcagagatgccttccttcccttcggggactggaacacaggtgctgcatggctgtcgtcagctcgtgtcgtgagatgttgggttaagtcccgcaacgagcgcaaccctcgcctttagttaccatcattcagttggggactctaaaggaaccgccggtgataagccggaggaaggtggggatgacgtcaagtcctcatggcccttacgcgctgggctacacacgtgctacaatggcggtgacagtgggcagcaaactcgcgagagtgcgctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaagga

SEQ ID NO: 8646 - DNA, 1495 bp, Sphingomonas sp. Root1294
  ref <308>: DATABASE ACCESSION NUMBER: NCBI ACCESSION: NZ_LMEJ01000008.1
  ref <309>: DATABASE ENTRY DATE: 2019-04-01
  ref <313>: RELEVANT RESIDUES IN SEQ ID NO: (1)..(1495)
tcaacttgagagtttgattctggctcagaacgaacgctggcggcatgcctaacacatgcaagtcgaacgagatcttcggatctagtggcgcacgggtgcgtaacgcgtgggaatctgcccttgggtacggaataactcaccgaaaggtgtgctaataccgtatgatgacgtaagtccaaagatttatcgcctgaggatgagcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagttagaggtgaaagcccggggctcaaccccggaattgcctttaagactgcatcgcttgaacgtcggagaggtgagtggaattccgagtgtagaggtgaaattcgtagatattcggaagaacaccagtggcgaaggcggctcactggacgactgttgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaagaaattgacgggggcctgcacaagcggtggagcatgtggtttaattcgaagcaacgcgcagaaccttaccaacgtttgacatccccagtatggatcgtggagacactttccttcagttcggctggctgggtgacaggtgctgcatggctgtcgtcagctcgtgtcgtgagatgttgggttaagtcccgcaacgagcgcaaccctcgcctttagttgccatcatttagttgggcactctaaaggaaccgccggtgataagccggaggaaggtggggatgacgtcaagtcctcatggcccttacgcgttgggctacacacgtgctacaatggcaactacagtgggcagcaatcccgcgagggcgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaaccgcaaggaggcaggcgaccacggtgggtttagcgactggggtgaagtcgtaacaaggtagccgtaggggaacctgcggctggatcacctcctttctaagga

SEQ ID NO: 8647 - DNA, 1496 bp, Sphingomonas sp. Root241
  ref <308>: DATABASE ACCESSION NUMBER: NCBI ACCESSION: NZ_LMIV01000002.1
  ref <309>: DATABASE ENTRY DATE: 2019-04-01
  ref <313>: RELEVANT RESIDUES IN SEQ ID NO: (1)..(1496)
aaacttgagagtttgatcatggctcagaatgaacgctggcggcatgcctaacacatgcaagtcgaacgaaggcttcggccttagtggcgcacgggtgcgtaacgcgtgggaatctgcccttgggttcggaataacagtgagaaattactgctaataccggatgatgtcgaaagaccaaagatttatcgcccgaggatgagcccgcgtaggattagctagttggtgaggtaagagctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttattcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtctgggtacttggtacttaggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcaactacagtgggcagcaatcctgcgagggtgagctaatctccaaaagttgtctcagttcggattgcactctgcaactcgagtgcatgaaggcggaatcgctagtaatcgcggatcagcatgccgcggtgaatacgttcccaggccttgtacacaccgcccgtcacaccatgggagttggattcacccgaaggcgttgcgctaactcagcaatgagaggcaggcgaccacggtgggtttagcgactggggtgaagtcgtaacaaggtagccgtaggggaacctgcggctggatcacctcctttctaagga

SEQ ID NO: 8648 - DNA, 1065 bp, Sphingomonas sp. Root50
  ref <308>: DATABASE ACCESSION NUMBER: NCBI ACCESSION: NZ_LMFM01000005.1
  ref <309>: DATABASE ENTRY DATE: 2019-04-01
  ref <313>: RELEVANT RESIDUES IN SEQ ID NO: (1)..(1065)
aacttgagagtttgattctggctcagaacgaacgctggcggcatgcctaacacatgcaagtcgaacgagatcttcggatctagtggcgcacgggtgcgtaacgcgtgggaatctgcccttgggtacggaataactcaccgaaaggtgtgctaataccgtatgatgacgtaagtccaaagatttatcgcctgaggatgagcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagttagaggtgaaagcccggggctcaaccccggaattgcctttaagactgcatcgcttgaacgtcggagaggtgagtggaattccgagtgtagaggtgaaattcgtagatattcggaagaacaccagtggcgaaggcggctcactggacgactgttgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaagaaattgacgggggcctgcacaagcggtggagcatgtggtttaattcgaagcaacgcgcagaaccttaccaacgtttgacatccccagtatggatcgtggagacactttccttcagttcggctggctgggtgacaggtgctgcatggctgtcgtcagctcgtgtcgtgagatgttgggttaagtcccgcaacgagcgcaaccctcgcc

SEQ ID NO: 8649 - DNA, 1495 bp, Sphingomonas sp. Root710
  ref <308>: DATABASE ACCESSION NUMBER: NCBI ACCESSION: NZ_LMIB01000016.1
  ref <309>: DATABASE ENTRY DATE: 2019-04-01
  ref <313>: RELEVANT RESIDUES IN SEQ ID NO: (1)..(1495)
tcaacttgagagtttgattctggctcagaacgaacgctggcggcatgcctaacacatgcaagtcgaacgaagtcttcggacttagtggcgcacgggtgcgtaacgcgtgggaatctgcccttaggtacggaataactcagggaaacttgtgctaataccgtatgatgtcttcggaccaaagatttatcgcctagggatgagcccgcgttggattagctagttggtggggtaaaggcccaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagttagaggtgaaagcccggggctcaaccccggaattgcctttaagactgcatcgcttgaacgtcggagaggtgagtggaattccgagtgtagaggtgaaattcgtagatattcggaagaacaccagtggcgaaggcggctcactggacgactgttgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaagaaattgacgggggcctgcacaagcggtggagcatgtggtttaattcgaagcaacgcgcagaaccttaccaacgtttgacatccctagtatggatcgtggagacactttccttcagttcggctggctaggtgacaggtgctgcatggctgtcgtcagctcgtgtcgtgagatgttgggttaagtcccgcaacgagcgcaaccctcgcctttagttgccatcattaagttgggtactctaaaggaaccgccggtgataagccggaggaaggtggggatgacgtcaagtcctcatggcccttacgcgttgggctacacacgtgctacaatggcaactacagtgggcagcgaactcgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaaccgcaaggaggcaggcgaccacggtgggtttagcgactggggtgaagtcgtaacaaggtagccgtaggggaacctgcggctggatcacctcctttctaagga

SEQ ID NO: 8650 - DNA, 1495 bp, Sphingomonas sp. Root720; identical to SEQ ID NO: 8646
  ref <308>: DATABASE ACCESSION NUMBER: NCBI ACCESSION: NZ_LMID01000015.1
  ref <309>: DATABASE ENTRY DATE: 2019-04-01
  ref <313>: RELEVANT RESIDUES IN SEQ ID NO: (1)..(1495)

SEQ ID NO: 8651 - DNA, 1492 bp, Sphingomonas sp. S-NIH.Pt15 0812
  ref <308>: DATABASE ACCESSION NUMBER: NCBI ACCESSION: NZ_QLJH01000071.1
  ref <309>: DATABASE ENTRY DATE: 2019-04-01
  ref <313>: RELEVANT RESIDUES IN SEQ ID NO: (1)..(1492)
aaacttgagagtttgatcatggctcagaacgaacgctggcggcatgcctaacacatgcaagtcgaacgatgctttcgggcatagtggcgcacgggtgcgtaacgcgtgggaatctgccctttggtctgggataactgttggaaacgacagctaataccggatgatgacgtaagtccaaagatttatcgccagaggatgagcccgcgtcggattagctagttggtggggtaaaggcctaccaaggcgacgatccgtagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagttagaggtgaaagcctggagctcaactccagaactgcctttgatactgcatggcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggcaggacgacttccagagatggatttcttcccttcggggacctgcacacaggtgctgcatggctgtcgtcagctcgtgtcgtgagatgttgggttaagtcccgcaacgagcgcaaccctcgcctttagttaccatcattcagttggggactctaaaggaaccgccggtgataagccggaggaaggtggggatgacgtcaagtcctcatggcccttacgcgctgggctacacacgtgctacaatggcggtgacagtgggcagcaaactcgcgagagtgcgctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaag

SEQ ID NO: 8652 - DNA, 1495 bp, Sphingomonas sp. S-NIH.Pt1 0416; identical to SEQ ID NO: 8553
  ref <308>: DATABASE ACCESSION NUMBER: NCBI ACCESSION: NZ_QLJL01000070.1
  ref <309>: DATABASE ENTRY DATE: 2019-04-01
  ref <313>: RELEVANT RESIDUES IN SEQ ID NO: (1)..(1495)

SEQ ID NO: 8653 - DNA, 1493 bp, Sphingomonas sp. S-NIH.Pt3 0716
  ref <308>: DATABASE ACCESSION NUMBER: NCBI ACCESSION: NZ_QLJK01000095.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaatacatgcaagtcgaacgagatcttcggatctagtggcgcacgggtgcgtaacgcgtgggaatctgcccttgggttcggaataacttctggaaacggaagctaataccggatgatgacgtaagtccaaagatttatcgcccaaggatgagcccgcgtaggattagctagttggtggggtaaaggctcaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctattcaagtcagaggtgaaagcccggggctcaaccccggaactgcctttgaaactagatagcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcagggcacatggtgttttggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggatcgtggagacactttccttcagttcggctggataggtgacaggtgctgcatggctgtcgtcagctcgtgtcgtgagatgttgggttaagtcccgcaacgagcgcaaccctcgcctttagttgccagcatttagttgggtactctaaaggaaccgccggtgataagccggaggaaggtggggatgacgtcaagtcctcatggcccttacgcgttgggctacacacgtgctacaatggcgactacagtgggcagccacctcgcgagagggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgtaaggaggcaggcgaccacagtgggtttagcgactggggtgaagtcgtaacaaggtagccgtaggggaacctgcggctggatcacctcctttctaag

SEQ ID NO: 8654 - DNA, 1498 bp, Sphingomonas sp. S17
  ref <308>: DATABASE ACCESSION NUMBER: NCBI ACCESSION: NZ_AFGG01000052.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgaaggcttcggccttagtggcgcacgggtgcgtaacgcgtgggaatctgcccttaggttcggaataacagctggaaacggctgctaataccggatgatatcgcgagatcaaagatttatcgcctgaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatggtaggacgacttccagagatggatttcttcccttcggggacctacacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacctagcaataggaagcaggcgaccacggtgggttcagcgactggggtgaagtcgtaacaaggtagccgtaggggaacctgcggctggatcacctcctttctaagga

SEQ ID NO: 8655 - DNA, 1497 bp, Sphingomonas sp. SKA58
  ref <308>: DATABASE ACCESSION NUMBER: NCBI ACCESSION: NZ_CH959308.1
  ref <309>: DATABASE ENTRY DATE: 2019-04-01
  ref <313>: RELEVANT RESIDUES IN SEQ ID NO: (1)..(1497)
tcaaacttgagagtttgatcctggctcagaacgaacgctggcggcatgcctaatacatgcaagtcgaacgagatcttcggatctagtggcgcacgggtgcgtaacgcgtgggaatctgcccttgggttcggaataacgtcgggaaactgacgctaataccggatgatgacgtaagtccaaagatttatcgcccagggatgagcccgcgtaggattagctagttggtggggtaaaggcctaccaaggcgacgatccttagctggtctgagaggatgatcagccacactgggactgagacacggcccagactcctacgggaggcagcagtagggaatattggacaatgggggcaaccctgatccagcaatgccgcgtgagtgatgaaggccttagggttgtaaagctcttttaccagagatgataatgacagtatctgggaataagccccggctaactccgtgccagcagccgcggtaatacggagggggctagcgttgttcggaattactgggcgtaaagcgcacgtaggcggcgatttaagtcagaggtgaaagcccggggctcaaccccggaactgcctttgagactggattgcttgaatccgggagaggtgagtggaattccgagtgtagaggtgaaattcgtagatattcggaagaacaccagtggcgaaggcggctcactggaccggcattgacgctgaggtgcgaaagcgtggggagcaaacaggattagataccctggtagtccacgccgtaaacgatgataactagctgccggggcacatggtgtttcggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctcatcgcgatttccagagatggatttcttcagttcggctggatgagtgacaggtgctgcatggctgtcgtcagctcgtgtcgtgagatgttgggttaagtcccgcaacgagcgcaaccctcgcctttagttgccagcatttggttgggtactctaaaggaaccgccggtgataagccggaggaaggtggggatgacgtcaagtcctcatggcccttacgcgctgggctacacacgtgctacaatggcgactacagtgggcagcgacctcgcgagggggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaactcgcaagagaggcaggcgaccacagtgggtttagcgactggggtgaagtcgtaacaaggtagccgtaggggaacctgcggctggatcacctcctttctaagga

SEQ ID NO: 8656 - DNA, 1497 bp, Sphingomonas sp. SRS2
  ref <308>: DATABASE ACCESSION NUMBER: NCBI ACCESSION: NZ_LARW01000137.1
  ref <309>: DATABASE ENTRY DATE: 2019-04-01
  ref <313>: RELEVANT RESIDUES IN SEQ ID NO: (1)..(1497)
tcaacttgagagtttgattctggctcagaacgaacgctggcggcatgcctaacacatgcaagtcgaacgagatcttcggatctagtggcgcacgggtgcgtaacgcgtgggaatctgcccttaggtacggaataactcaccgaaaggtgtgctaataccgtatgatgacgtaagtccaaagatttatcgcctaaggatgagcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgtacgtaggcggctttgtaagttagaggtgaaagcccggggctcaaccccggaattgcctttaagactgcatcgcttgaatcgcggagaggtgagtggaattccgagtgtagaggtgaaattcgtagatattcggaagaacaccagtggcgaaggcggctcactggacgcgtattgacgctgaggtacgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaagaaattgacgggggcctgcacaagcggtggagcatgtggtttaattcgaagcaacgcgcagaaccttaccaacgtttgacatccctagtatggatcgtggagacactttccttcagttcggctggctaggtgacaggtgctgcatggctgtcgtcagctcgtgtcgtgagatgttgggttaagtcccgcaacgagcgcaaccctcgcctttagttgccatcattaagttgggtactctaaaggaaccgccggtgataagccggaggaaggtggggatgacgtcaagtcctcatggcccttacgcgttgggctacacacgtgctacaatggcaactacagtgggcagcgaactcgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgctctaacccgcaagggaggaaggcgaccacggtgggtttagcgactggggtgaagtcgtaacaaggtagccgtaggggaacctgcggctggatcacctcctttctaagga

SEQ ID NO: 8657 - DNA, 1538 bp, Sphingomonas sp. STIS6.2
  ref <308>: DATABASE ACCESSION NUMBER: NCBI ACCESSION: NZ_JPDP02000162.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacgaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactcatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaatcttccagagatggaggagtgccttcgggaacattgagacaggtgctgcatggctgtcgtcagctcgtgtcgtgagatgttgggttaagtcccgtaacgagcgcaacccttgtccttagttaccagcacgtgatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaa

SEQ ID NO: 8658 - DNA, 1491 bp, Sphingomonas sp. SYSUP0001
  ref <308>: DATABASE ACCESSION NUMBER: NCBI ACCESSION: NZ_QWDF01000001.1
  ref <309>: DATABASE ENTRY DATE: 2019-04-01
  ref <313>: RELEVANT RESIDUES IN SEQ ID NO: (1)..(1491)
aacttgagagtttgattctggctcagaacgaacgctggcggcatgcctaacacatgcaagtcgaacgagaccttcgggtctagtggcgcacgggtgcgtaacgcgtgggaatctgcccttgggttcgggataacagttggaaacgactgctaataccggatgatgacttcggtccaaagatttatcgcccagggatgagcccgcgtaggattagctagttggtagggtaaaggcctaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcgcgtaggcggctttgtaagttagaggtgaaagcccggagctcaactccggaactgcctttaagactgcatcgctagaattgtggagaggtaagtggaattccgagtgtagaggtgaaattcgtagatattcggaagaacaccagtggcgaaggcgacttactggacacatattgacgctgaggtgcgaaagcgtggggagcaaacaggattagataccctggtagtccacgccgtaaacgatgatgactagctgtcggggctcttggagtttcggtggcgcagctaacgcattaagtcatccgcctggggagtacggccgcaaggttaaaactcaaagaaattgacgggggcctgcacaagcggtggagcatgtggtttaattcgaagcaacgcgcagaaccttaccagcgtttgacatggtaggacggtttctggagacagattccttcccttacgggacctacacacaggtgctgcatggctgtcgtcagctcgtgtcgtgagatgttgggttaagtcccgcaacgagcgcaaccctcgtctctagttgctaccatttagttgagcactctagagaaactgccggtgataagccggaggaaggtggggatgacgtcaagtcctcatggcccttacgcgctgggctacacacgtgctacaatggcggtgacagtgggcagcaaactcgcgagagtgagcaaatcccaaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgcgctaacccgcaagggaggcagctgaccacggtgggatcagcgactggggtgaagtcgtaacaaggtagccgtaggggaacctgcggctggatcacctcctttctaag

SEQ ID NO: 8659 - DNA, 1498 bp, Sphingomonas sp. TDK1
  ref <308>: DATABASE ACCESSION NUMBER: NCBI ACCESSION: NZ_LXVY01000047.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgagatcttcggatctagtggcgcacgggtgcgtaacgcgtgggaatctgccttggggttcggaataactccccgaaaggggtgctaataccggatgatgtcgaaagaccaaagatttatcgccctgagatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatggtaggacgactggcagagatgcctttcttcccttcggggacctacacacaggtgctgcatggctgtcgtcagctcgtgtcgtgagatgttgggttaagtcccgcaacgagcgcaaccctcgactttagttaccatcattaagttgggtactttaaagtaaccgccggtgataagccggaggaaggtggggatgacgtcaagtcctcatggcccttacgcgctgggctacacacgtgctacaatggcaagtacagtgggcagcaatcccgcgagggtgagctaatctccaaaacttgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcagcaatgagaggcaggcgaccacggtgggcttagcgactggggtgaagtcgtaacaaggtagccgtaggggaacctgcggctggatcacctcctttctaagga

SEQ ID NO: 8660 - DNA, 1488 bp, Sphingomonas sp. TF3
  ref <308>: DATABASE ACCESSION NUMBER: NCBI ACCESSION: NZ_RWKS01000055.1
  ref <309>: DATABASE ENTRY DATE: 2019-04-01
  ref <313>: RELEVANT RESIDUES IN SEQ ID NO: (1)..(1488)
aaacttgagagtttgatcatggctcagaatgaacgctggcggcatgcctaacacatgcaagtcgaacgaaggcttcggccttagtggcgcacgggtgcgtaacgcgtgggaatctgccctcaggttcggaataacagcgagaaattgctgctaataccggatgatatcgcgagatcaaagatttatcgcctgaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcggggctcttagagcttcggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttcgggagaccgatctcttcccttcggggactggaacacaggtgctgcatggctgtcgtcagctcgtgtcgtgagatgttgggttaagtcccgcaacgagcgcaaccctcgtccttagttgccatcatttagttgggcactctaaggaaaccgccggtgataagccggaggaaggtggggatgacgtcaagtcctcatggcccttacgcgctgggctacacacgtgctacaatggcggtgacagtgggcagcaatctcgcaagggtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcgtaacaaggtagccgtaggggaacctgcggctggatcacctcctttcta

SEQ ID NO: 8661 - DNA, 228 bp, Sphingomonas sp. TPD3009
  ref <308>: DATABASE ACCESSION NUMBER: NCBI ACCESSION: NZ_QDFN01000001.1
  ref <309>: DATABASE ENTRY DATE: 2019-04-01
  ref <313>: RELEVANT RESIDUES IN SEQ ID NO: (1)..(228)
aaacttgagagtttgatcatggctcagaacgaacgctggcggcatgcctaacacatgcaagtcgaacgagtgccttcgggtgctagtggcgcacgggtgcgtaacgcgtgggaatctgccctttggttcggaataacagttggaaacgactgctaataccggatgatgacgaaagtccaaagatttatcgccagaggatgagcccgcgtaggattagctagttggtgt

SEQ ID NO: 8662 - DNA, 1493 bp, Sphingomonas sp. TZW2008
  ref <308>: DATABASE ACCESSION NUMBER: NCBI ACCESSION: NZ_BDJB01000021.1
  ref <309>: DATABASE ENTRY DATE: 2019-04-01
  ref <313>: RELEVANT RESIDUES IN SEQ ID NO: (1)..(1493)
aacttgagagtttgatcatggctcagaatgaacgctggcggcatgcctaacacatgcaagtcgaacgaaggcttcggccttagtggcgcacgggtgcgtaacgcgtgggaatctgccccttggttcggaataacagttagaaatgactgctaataccggatgacgacgtaagtccaaagatttatcgccgagggatgagcccgcgtaggattagctagttggtgtggtaagagcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagttagaggtgaaagcctggagctcaactccagaattgcctttaagactgcatcgctcgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggtaggacggcttccagagatggattccttcccttcggggacctacacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcaactacagtgggcagcaatcccgcgagggtgagctaatctccaaaagttgtctcagttcggattgttctctgcaactcgagagcatgaaggcggaatcgctagtaatcgcggatcagcacgccgcggtgaatacgttcccaggccttgtacacaccgcccgtcacaccatgggagttggattcacccgaaggcgtttcgctaacccgcaagggaggcaggcgaccacggtgggtttagcgactggggtgaagtcgtaacaaggtagccgtaggggaacctgcggctggatcacctcctttctaagga

SEQ ID NO: 8663 - DNA, 1496 bp, Sphingomonas sp. UNC305MFCol5.2
  ref <308>: DATABASE ACCESSION NUMBER: NCBI ACCESSION: NZ_JOOE01000003.1
  ref <309>: DATABASE ENTRY DATE: 2019-04-01
  ref <313>: RELEVANT RESIDUES IN SEQ ID NO: (1)..(1496)
aaacttgagagtttgatcatggctcagaatgaacgctggcggcatgcctaacacatgcaagtcgaacgaaggcttcggccttagtggcgcacgggtgcgtaacgcgtgggaatctgcccttgggttcggaataacagtgagaaattactgctaataccggatgatgtcgaaagaccaaagatttatcgcccgaggatgagcccgcgtaggattagctagttggtgaggtaagagctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttattcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtctgggtacttggtacttaggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcaactacagtgggcagcaatcccgcgagggtgagctaatctccaaaagttgtctcagttcggattgcactctgcaactcgagtgcatgaaggcggaatcgctagtaatcgcggatcagcatgccgcggtgaatacgttcccaggccttgtacacaccgcccgtcacaccatgggagttggattcacccgaaggcgttgcgctaactcagcaatgagaggcaggcgaccacggtgggtttagcgactggggtgaagtcgtaacaaggtagccgtaggggaacctgcggctggatcacctcctttctaagga

SEQ ID NO: 8664 - DNA, 1491 bp, Sphingomonas sp. URHD0007
  ref <308>: DATABASE ACCESSION NUMBER: NCBI ACCESSION: NZ_QEQM01000001.1
  ref <309>: DATABASE ENTRY DATE: 2019-04-01
  ref <313>: RELEVANT RESIDUES IN SEQ ID NO: (1)..(1491)
aacttgagagtttgattctggctcagaacgaacgctggcggcatgcctaacacatgcaagtcgaacgagaccttcgggtctagtggcgcacgggtgcgtaacgcgtgggaatctgcccttgggttcgggataacagttggaaacgactgctaataccggatgatgacttcggtccaaagatttatcgcccagggatgagcccgcgtcggattagctagttggtggggtaaaagctcaccaaggcgacgatccgtagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggctttgtaagttagaggtgaaagcccggggctcaactccggaattgcctttaagactgcatcgctagaattgtggagaggtaagtggaattccgagtgtagaggtgaaattcgtagatattcggaagaacaccagtggcgaaggcgacttactggacacatattgacgctgaggtgcgaaagcgtggggagcaaacaggattagataccctggtagtccacgccgtaaacgatgatgactagctgtcggggcgcttagcgttccggtggcgcagctaacgcgttaagtcatccgcctggggagtacggccgcaaggttaaaactcaaagaaattgacgggggcctgcacaagcggtggagcatgtggtttaattcgaagcaacgcgcagaaccttaccagcgtttgacatgccaggacggtttccagagatgaattccttcccttacgggacctggacacaggtgctgcatggctgtcgtcagctcgtgtcgtgagatgttgggttaagtcccgcaacgagcgcaaccctcgtctttagttgccaccatttagttgggcactctaaagaaactgccggtgataagccggaggaaggtggggatgacgtcaagtcctcatggcccttacgcgctgggctacacacgtgctacaatggcggtgacaatgggcagcaaactcgcgagagtgagcaaatcccaaaaagccgtctcagttcggattgttctctgcaactcgagagcatgaaggcggaatcgctagtaatcgcggatcagcacgccgcggtgaatacgttcccaggccttgtacacaccgcccgtcacaccatgggagttggtttcacccgaaggcgctacgctaacccgcaagggaggcaggcgaccacggtgggatcagcgactggggtgaagtcgtaacaaggtagccgtaggggaacctgcggctggatcacctcctttctaag

SEQ ID NO: 8665 - DNA, 1493 bp, Sphingomonas sp. URHD0057
  ref <308>: DATABASE ACCESSION NUMBER: NCBI ACCESSION: NZ_JIAU01000005.1
  ref <309>: DATABASE ENTRY DATE: 2019-04-01
  ref <313>: RELEVANT RESIDUES IN SEQ ID NO: (1)..(1493)
aacttgagagtttgattctggctcagaacgaacgctggcggcatgcctaacacatgcaagtcgaacgagaccttcgggtctagtggcgcacgggtgcgtaacgcgtgggaatctgccctctggtacggaataactcagggaaacttgagctaataccgtataatgacttcggtccaaagatttatcgcctgaggatgagcccgcgtaggattagcttgttggtgaggtaaaagctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggctttgcaagttagaggtgaaagcccggggctcaactccggaattgcctttaaaactgcatcgctagaattgtggagaggtgagtggaattccgagtgtagaggtgaaattcgtagatattcggaagaacaccagtggcgaaggcgactcactggacacatattgacgctgaggtgcgaaagcgtggggagcaaacaggattagataccctggtagtccacgccgtaaacgatgatgactagctgtcggggcgcttggcgcttcggtggcgcagctaacgcgttaagtcatccgcctggggagtacggccgcaaggttaaaactcaaagaaattgacgggggcctgcacaagcggtggagcatgtggtttaattcgaagcaacgcgcagaaccttaccagcgtttgacatggtaggacggtttccagagatggattccttcccttacgggacctacacacaggtgctgcatggctgtcgtcagctcgtgtcgtgagatgttgggttaagtcccgcaacgagcgcaaccctcgtctttagttgccatcatttagttgggcactctaaagaaactgccggtgataagccggaggaaggtggggatgacgtcaagtcctcatggcccttacgcgctgggctacacacgtgctacaatggcggtgacagagggcggcaaacccgcgagggtgagctaatctccaaaagccgtctcagttcggattgttctctgcaactcgagagcatgaaggcggaatcgctagtaatcgcggatcagcacgccgcggtgaatacgttcccaggccttgtacacaccgcccgtcacaccatgggagttggattgacccgaaggtggtgagctaacccgcaagggaggcagccaaccacggtcggttcagcgactggggtgaagtcgtaacaaggtagccgtaggggaacctgcggctggatcacctcctttctaagga

SEQ ID NO: 8666 - DNA, 1494 bp, Sphingomonas sp. UV9
  ref <308>: DATABASE ACCESSION NUMBER: NCBI ACCESSION: NZ_SCIN01000012.1
  ref <309>: DATABASE ENTRY DATE: 2019-04-01
  ref <313>: RELEVANT RESIDUES IN SEQ ID NO: (1)..(1494)
aaacttgagagtttgatcatggctcagaatgaacgctggcggcatgcctaacacatgcaagtcgaacgaaggcttcggccttagtggcgcacgggtgcgtaacgcgtgggaatctgccccttggttcggaataacagttggaaacgactgctaataccggatgacgacgtaagtccaaagatttatcgccgagggatgagcccgcgtaggattaggtagttggtgtggtaaaggcgcaccaagccgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacaggattagataccctggtagtccacgccgtaaacgatgataactagctgtccggacacttggtgtttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatggcaggacgacttccagagatggatttcttcccttcggggacctgcacacaggtgctgcatggctgtcgtcagctcgtgtcgtgagatgttgggttaagtcccgcaacgagcgcaaccctcgaccttagttgccatcatttagttgggcactttaaggtaaccgccggtgataagccggaggaaggtggggatgacgtcaagtcctcatggcccttacgcgctgggctacacacgtgctacaatggcggtgacagtgggcagcaagcacgcgagtgtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaactcagcaatgagaggcaggcgaccacggtgggtttagcgactggggtgaagtcgtaacaaggtagccgtaggggaacctgcggctggatcacctcctttctaag

SEQ ID NO: 8667 - DNA, 1496 bp, Sphingomonas sp. WG; identical to SEQ ID NO: 8568
  ref <308>: DATABASE ACCESSION NUMBER: NCBI ACCESSION: NZ_LNOS01000084.1
  ref <309>: DATABASE ENTRY DATE: 2019-04-01
  ref <313>: RELEVANT RESIDUES IN SEQ ID NO: (1)..(1496)

SEQ ID NO: 8668 - DNA, 1495 bp, Sphingomonas sp. Y57
  ref <308>: DATABASE ACCESSION NUMBER: NCBI ACCESSION: NZ_LDES01000178.1
  ref <309>: DATABASE ENTRY DATE: 2019-04-01
  ref <313>: RELEVANT RESIDUES IN SEQ ID NO: (1)..(1495)
tcaacttgagagtttgattctggctcagaacgaacgctggcggcatgcctaacacatgcaagtcgaacgaaggcttcggccttagtggcgcacgggtgcgtaacgcgtgggaatctgcccttgggtacggaataactcaccgaaaggtgtgctaataccgtatgatgacgtaagtccaaagatttatcgcctgaggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagttagaggtgaaagcccggggctcaaccccggaattgcctttaagactgcatcgcttgaacgtcggagaggtgagtggaattccgagtgtagaggtgaaattcgtagatattcggaagaacaccagtggcgaaggcggctcactggacgactgttgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaagaaattgacgggggcctgcacaagcggtggagcatgtggtttaattcgaagcaacgcgcagaaccttaccaacgtttgacatccctagtatggttagtggagacactttccttcagttcggctggctaggtgacaggtgctgcatggctgtcgtcagctcgtgtcgtgagatgttgggttaagtcccgcaacgagcgcaaccctcgcctttagttgccatcattaagttgggtactctaaaggaaccgccggtgataagccggaggaaggtggggatgacgtcaagtcctcatggcccttacgcgttgggctacacacgtgctacaatggcaactacagtgggcagcaatcccgcgagggcgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaaccgcaaggaggcaggcgaccacggtgggtttagcgactggggtgaagtcgtaacaaggtagccgtaggggaacctgcggctggatcacctcctttctaagga

SEQ ID NO: 8669 - DNA, 906 bp, Sphingomonas sp. YL-JM2C
  ref <308>: DATABASE ACCESSION NUMBER: NCBI ACCESSION: NZ_ASTM01000254.1
  ref <309>: DATABASE ENTRY DATE: 2019-04-01
  ref <313>: RELEVANT RESIDUES IN SEQ ID NO: (1)..(906)
aacttgagagtttgattctggctcagaacgaacgctggcggcatgcctaacacatgcaagtcgaacgaaggcttcggccttagtggcgcacgggtgcgtaacgcgtgggaatctgcccttgggtacggaataactcaccgaaaggtgtgctaataccgtatgacgacgtaagtccaaagatttatcgcctgaggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagttagaggtgaaagcccggggctcaaccccggaatagcctttaagactgcatcgcttgaacgtcggagaggtgagtggaattccgagtgtagaggtgaaattcgtagatattcggaagaacaccagtggcgaaggcggctcactggacgactgttgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaagaaattgacgggggcctgcacaagcggtggagcatgtggtttaattcga

SEQ ID NO: 8670 - DNA, 1495 bp, Sphingomonas sp. ZDH117
  ref <308>: DATABASE ACCESSION NUMBER: NCBI ACCESSION: NZ_QWLV01000012.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgaagccttcgggcttagtggcgcacgggtgcgtaacacgtgggaatctgcccttgggttcggaataacagttggaaacgactgctaataccggatgatgacgtaagtccaaagatttatcgcccagggatgagcccgcgtcggattagctagttggtggggtaaaggcctaccaaggcgacgatccgtagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggctttgtaagttagaggtgaaagcctggagctcaactccagaactgcctttaagactgcatcgcttgaatccgggagaggtgagtggaattccgagtgtagaggtgaaattcgtagatattcggaagaacaccagtggcgaaggcggctcactggaccggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatggctagtatggtttccagagatggattccttcagttcggctggctagcacacaggtgctgcatggctgtcgtcagctcgtgtcgtgagatgttgggttaagtcccgcaacgagcgcaaccctcgcctttagttaccatcattcagttgggtactctaaaggaaccgccggtgataagccggaggaaggtggggatgacgtcaagtcctcatggcccttacgcgctgggctacacacgtgctacaatggcgactacagtgggcagcaatcccgcgagggtgagctaatctccaaaagtcgtctcagttcggattgcactctgcaactcgagtgcatgaaggcggaatcgctagtaatcgcggatcagcatgccgcggtgaatacgttcccaggccttgtacacaccgcccgtcacaccatgggagttggattcacccgaaggcgttgcgctaacccgtaagggaggcaggcgaccacggtgggtttagcgactggggtgaagtcgtaacaaggtagccgtaggggaacctgcggctggatcacctcctttctaag

SEQ ID NO: 8671 - DNA, 1496 bp, Sphingomonas taxi
  ref <308>: DATABASE ACCESSION NUMBER: NCBI ACCESSION: NZ_CP009571.1
  ref <309>: DATABASE ENTRY DATE: 2019-04-01
  ref <313>: RELEVANT RESIDUES IN SEQ ID NO: (1)..(1496)
aaacttgagagtttgatcatggctcagaacgaacgctggcggcatgcctaacacatgcaagtcgaacgagatcttcggatctagtggcgcacgggtgcgtaacgcgtgggaatctgccctttggttcggaataacagttggaaacgactgctaataccggatgatgacgtaagtccaaagatttatcgccagaggatgagcccgcgtaggattagctagttggtgtggtaagagcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagttagaggtgaaagcctggagctcaactccagaattgcctttaagactgcatcgcttgaatccagaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttctggagacagatctcttcccttcggggactggaacacaggtgctgcatggctgtcgtcagctcgtgtcgtgagatgttgggttaagtcccgcaacgagcgcaaccctcgcctttagttaccatcatttagttggggactctaaaggaaccgccggtgataagccggaggaaggtggggatgacgtcaagtcctcatggcccttacgcgctgggctacacacgtgctacaatggcggtgacagtgggcagcaaactcgcgagagtgcgctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgtaagagaggcaggcgaccacggtgggcttagcgactggggtgaagtcgtaacaaggtagccgtaggggaacctgcggctggatcacctcctttctaagga

SEQ ID NO: 8672 - DNA, 1493 bp, Sphingomonas turrisvirgatae
  ref <308>: DATABASE ACCESSION NUMBER: NCBI ACCESSION: NZ_MDDS01000052.1
  ref <309>: DATABASE ENTRY DATE: 2019-04-01
  ref <313>: RELEVANT RESIDUES IN SEQ ID NO: (1)..(1493)
caaacttgagagtttgatcctggctcagaatgaacgctggcggcatgcctaacacatgcaagtcgaacgagaccttcgggtctagtggcgcacgggtgcgtaacgcgtgggaatctgcccttgggttcggaataacagttagaaatgactgctaataccggatgatgtcttcggaccaaagatttatcgcccaaggatgagcccgcgtaggattagctagttggtgaggtaaaagctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaacttcgtgccagcagccgcggtaatacgaggggagctagcgttattcggaattactgggcgtaaagcgcacgtaggcggctttgtaagtaaggggtgaaagcccagagctcaactctggaattgccttttagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtctgggtgcttggcacttaggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgtccggacgatttccagagatggatttcttcccttcggggactggaacacaggtgctgcatggctgtcgtcagctcgtgtcgtgagatgttgggttaagtcccgcaacgagcgcaaccctcgcctttagttaccatcattcagttgggtactctaaaggaaccgccggtgataagccggaggaaggtggggatgacgtcaagtcctcatggcccttacgcgctgggctacacacgtgctacaatggcaactacagtgggcagcaatcccgcgagggtgagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaag

SEQ ID NO: 8673 - DNA, 1499 bp, Sphingomonas wittichii
  ref <308>: DATABASE ACCESSION NUMBER: NCBI ACCESSION: NZ_JQMC01000009.1
  ref <309>: DATABASE ENTRY DATE: 2019-04-01
  ref <313>: RELEVANT RESIDUES IN SEQ ID NO: (1)..(1499)
tcaacttgagagtttgattctggctcagaacgaacgctggcggcatgcctaacacatgcaagtcgaacgattgccttcgggtgatagtggcgcacgggtgcgtaacgcgtgggaatctgcctttcggtacggaataactcagggaaacttgtgctaataccgtatgatgtcgcgagaccaaagatttatcgccgaaagatgagcccgcgtaggattagctagttggtggggtaaaggcctaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagttagaggtgaaagcctgatgctcaacatcagaattgcctttaagactgcatcgcttgaacgtcggagaggtgagtggaattccgagtgtagaggtgaaattcgtagatattcggaagaacaccagtggcgaaggcggctcactggacgactgttgacgctgaggtgcgaaagcgtggggagcaaacaggattagataccctggtagtccacgccgtaaacgatgataactagctgtccgggcacttggtgcctgggtggcgcagctaacgcattaagttatccgcctggggagtacggccgcaaggttaaaactcaaagaaattgacgggggcctgcacaagcggtggagcatgtggtttaattcgaagcaacgcgcagaaccttaccaacgtttgacatccctagtatggatcgtggagacactttccttcagttcggctggctaggtgacaggtgctgcatggctgtcgtcagctcgtgtcgtgagatgttgggttaagtcccgcaacgagcgcaaccctcgcctttagttgccatcattcagttgggcactctaaaggaaccgccggtgataagccggaggaaggtggggatgacgtcaagtcctcatggcccttacgcgttgggctacacacgtgctacaatggcggtgacagtgggcagcaaactcgcgagagtgagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgctctaacccgcaagggaggaaggcgaccacggtgggtttagcgactggggtgaagtcgtaacaaggtagccgtaggggaacctgcggctggatcacctcctttctaagga

SEQ ID NO: 8674 - DNA, 1496 bp, Sphingomonas yabuuchiae
  ref <308>: DATABASE ACCESSION NUMBER: NCBI ACCESSION: NZ_LDTF01000049.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcctaacacatgcaagtcgaacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgactggcagagatgcctttcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgtaagggaagcaggcgaccacggtgggttcagcgactggggtgaagtcgtaacaaggtagccgtaggggaacctgcggctggatcacctcctttctaagga

SEQ ID NO: 8675 - DNA, 1498 bp, Sphingopyxis alaskensis
  ref <308>: DATABASE ACCESSION NUMBER: NCBI ACCESSION: NC_008048.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgagaccttcgggtctagtggcgcacgggtgcgtaacgcgtgggaatctgcccttgggtacggaataactcagagaaatttgagctaataccgtataatgacttcggtccaaagatttatcgcccaaggatgagcccgcgtaagattagctagttggtggggtaaaggcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcgcgtaggcggttttttaagtcagaggtgaaagcccagtgctcaacactggaactgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattagagagatcttttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcaactacagtgggcagcaacctcgcgaggggtagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaagga

SEQ ID NO: 8676 - DNA, 1499 bp, Sphingopyxis baekryungensis
  ref <308>: DATABASE ACCESSION NUMBER: NCBI ACCESSION: NZ_ATUR01000002.1
  ref <309>: DATABASE ENTRY DATE: 2019-04-01
  ref <313>: RELEVANT RESIDUES IN SEQ ID NO: (1)..(1499)
caaacttgagagtttgatcctggctcagaacgaacgctggcggcatgcctaacacatgcaagtcgaacgaacccttcggggttagtggcgcacgggtgcgtaacgcgtgggaatctgccctttgctgcgggataacagtgagaaatcgctgctaataccgcataatgactacggtccaaagatttatcggcaaaggatgagcccgcgtaagattagcttgttggtggggtaaaagcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggtgattcaagtcagaggtgaaagcccggggctcaaccccggaactgcctttgaaactagattgctagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagttgttcgggccattgaggcttgagtgacgcagctaacgcactaagttatccgcctggggagtacggtcgcaagattaaaactcaaaggaattgacgggggcctgcacaagcggtggagcatgtggtttaattcgaagcaacgcgcagaaccttaccagcttttgacatcctgatcgcggattagagagatcttttccttcagttcggctggatcagtgacaggtgctgcatggctgtcgtcagctcgtgtcgtgagatgttgggttaagtcccgcaacgagcgcaaccctcatccttagttgccaccatttagttgggcactctaaggaaactgccggtgataagccggaggaaggtggggatgacgtcaagtcctcatggcccttacaagctgggctacacacgtgctacaatggcgatgacagtgggcagctacttcgcaagaagatgctaatctctaaaagtcgtctcagttcggattggactctgcaactcgagtccatgaaggcggaatcgctagtaatcgcggatcagcatgccgcggtgaatacgttcccaggccttgtacacaccgcccgtcacaccatgggagttggattcacccgaaggtggtgcgctaacctgcttgcaggaggcagccaaccacggtgggttcagcgactggggtgaagtcgtaacaaggtagccgtaggggaacctgcggctggatcacctcctttctaagga

SEQ ID NO: 8677 - DNA, 1498 bp, Sphingopyxis flava
  ref <308>: DATABASE ACCESSION NUMBER: NCBI ACCESSION: NZ_FUYP01000004.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgagaccttcgggtctagtggcgcacgggtgcgtaacgcgtgggaatctgcccttgggtgcggaataacttcccgaaagggatgctaataccgcataatgtcgtaagaccaaagatttatcgcccaaggatgagcccgcgtaagattagctagttggtggggtaaaagcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggatgataatgacagtaccgggagaataagctccggctaactccgtgccagcagccgcggtaatacggagggagctagcgttgttcggaattactgggcgtaaagcgcgcgtaggcggtttttcaagtcaggggtgaaagcccggggctcaaccccggaattgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccggactcatagagtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattagagagatcttttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcggtgacagtgggcagcaaccctgcgaggggtagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaagga

SEQ ID NO: 8678 - DNA, 1498 bp, Sphingopyxis fribergensis
  ref <308>: DATABASE ACCESSION NUMBER: NCBI ACCESSION: NZ_CP009122.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgaactcttcggagttagtggcgcacgggtgcgtaacgcgtgggaatctgcccttgggtacggaataactcagagaaatttgtgctaataccgtataatgtcttcggaccaaagatttatcgcccaaggatgagcccgcgtaagattagctagttggtgaggtaaaagctcaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcgcgtaggcggttttttaagtcagaggtgaaagcccagtgctcaacactggaactgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggttcatagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctaatcgcggatcgtagagatactttccttcagttcggctggattagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcaactacagtgggcagcaaccgggcgaccggtagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaagga

SEQ ID NO: 8679 - DNA, 1498 bp, Sphingopyxis granuli
  ref <308>: DATABASE ACCESSION NUMBER: NCBI ACCESSION: NZ_CP019153.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgaagtcttcggacttagtggcgcacgggtgcgtaacgcgtgggaatctacccttgggtacggaataactcagagaaatttgtgctaataccgtataatgacttcggtccaaagatttatcgcccaaggatgagcccgcgtaagattagctagttggtggggtaaaagcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggatgataatgacagtaccgggagaataagctccggctaactccgtgccagcagccgcggtaatacggagggagctagcgttgttcggaattactgggcgtaaagcgcgcgtaggcggttttccaagtcaggggtgaaagcccggggctcaaccccggaatagcccttgaaactggaagactagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggttcatagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggttaccagagatggtttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcggtgacagtgggcagcaactccgcgaggagtagctaatctccaaaaaccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaagga

SEQ ID NO: 8680 - DNA, 1498 bp, Sphingopyxis macrogoltabida
  ref <308>: DATABASE ACCESSION NUMBER: NCBI ACCESSION: NZ_CP013344.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgaagtcttcggacttagtggcgcacgggtgcgtaacgcgtgggaatctgcccttgggtacggaataactcagagaaatttgtgctaataccgtataatgacttcggtccaaagatttatcgcccaaggatgagcccgcgtaagattagctagttggtggggtaaaagcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggatgataatgacagtaccgggagaataagctccggctaactccgtgccagcagccgcggtaatacggagggagctagcgttgttcggaattactgggcgtaaagcgcgcgtaggcggttttttaagtcagaggtgaaagcccggggctcaaccccggaattgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggttcatagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattagagagatcttttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcggtgacagtgggcagcaaccgggcgaccggtagctaatctccaaaaaccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaagga

SEQ ID NO: 8681 - DNA, 1498 bp, Sphingopyxis sp. 113P3
  ref <308>: DATABASE ACCESSION NUMBER: NCBI ACCESSION: NZ_CP009452.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgagaccttcgggtctagtggcgcacgggtgcgtaacgcgtgggaatctgcccttgggtgcggaataacttcccgaaagggatgctaataccgcataatgtcgtaagaccaaagatttatcgcccagggatgagcccgcgtaagattagctagttggtggggtaaaagcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggatgataatgacagtaccgggagaataagctccggctaactccgtgccagcagccgcggtaatacggagggagctagcgttgttcggaattactgggcgtaaagcgcgcgtaggcggttttttaagtcagaggtgaaagcccggggctcaaccccggaattgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccggactcatagagtttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattggagagatcttttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcggtgacagtgggcagcaaccctgcgaggggtagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaagga

SEQ ID NO: 8682 - DNA, 1498 bp, Sphingopyxis sp. A083
  ref <308>: DATABASE ACCESSION NUMBER: NCBI ACCESSION: NZ_LNSK01000004.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgagatcttcggatctagtggcgcacgggtgcgtaacgcgtgggaatctgcccttgggtacggaataactcagagaaatttgtgctaataccgtataatgtcttcggaccaaagatttatcgcccaaggatgagcccgcgtaggattagctagttggtgaggtaaaagctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggatgataatgacagtaccgggagaataagctccggctaacttcgtgccagcagccgcggtaatacgaggggagctagcgttgttcggaattactgggcgtaaagcgcgcgtaggcggttttttaagtcagaggtgaaagcccggggctcaaccccggaatagcctttgaaactggaaaactagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggctcatagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggttaccagagatggtttccttcagttcggctggatcagtgacaggtgctgcatggctgtcgtcagctcgtgtcgtgagatgttgggttaagtcccgcaacgagcgcaaccctcatccctagttgccatcattaagttgggcactctaaggaaactgccggtgataagccggaggaaggtggggatgacgtcaagtcctcatggcccttacgcgctgggctacacacgtgctacaatggcggtgacagtgggcagcaacctcgcgagaggtagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaagga

SEQ ID NO: 8683 - DNA, 1498 bp, Sphingopyxis sp. C-1
  ref <308>: DATABASE ACCESSION NUMBER: NCBI ACCESSION: NZ_BBRO01000001.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgaagtcttcggacttagtggcgcacgggtgcgtaacgcgtgggaatctgcccttgggtacggaataactcagagaaatttgtgctaataccgtataatgtcttcggaccaaagatttatcgcccaaggatgagcccgcgtaagattagctagttggtggggtaaaagcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcgcgtaggcggttttttaagtcagaggtgaaagcccagtgctcaacactggaactgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggttcatagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattagagagatcttttccttcagttcggctggatcagtgacaggtgctgcatggctgtcgtcagctcgtgtcgtgagatgttgggttaagtcccgcaacgagcgcaaccctcatccctagttgccatcattaagttgggcactctaaggaaactgccggtgataagccggaggaaggtggggatgacgtcaagtcctcatggcccttacgcgctgggctacacacgtgctacaatggcaactacagtgggcagcaacctcgcgaggggtagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaagga

SEQ ID NO: 8684 - DNA, 1493 bp, Sphingopyxis sp. EG6
  ref <308>: DATABASE ACCESSION NUMBER: NCBI ACCESSION: NZ_AP017603.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaacacatgcaagtcgaacgaagtcttcggacttagtggcgcacgggtgcgtaacgcgtgggaatctgcccttgggtacggaataactcagagaaatttgtgctaataccgtataatgtcttcggaccaaagatttatcgcccaaggatgagcccgcgtaagattagctagttggtggggtaaaagcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggttttttaagtcagaggtgaaagcccagtgctcaacactggaactgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactatctgttcgggctcatagagcttgagtggagcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggatagtggagacactttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcaactacagtgggcagcaacctcgcgaggggtagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttcta

SEQ ID NO: 8685 - DNA, 1495 bp, Sphingopyxis sp. FD7
  ref <308>: DATABASE ACCESSION NUMBER: NCBI ACCESSION: NZ_AP017898.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgagaccttcgggtctagtggcgcacgggtgcgtaacgcgtgggaatctgcccttgggtgcggaataacttcccgaaagggatgctaataccgcataatgtcgcaagaccaaagatttatcgcccaaggatgagcccgcgtaggattagctagttggtggggtaaaagcctaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcgcgtaggcggttttttaagtcagaggtgaaagcccggggctcaaccccggaattgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattagagagatcttttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcaactacagtgggcagcaacctcgcgaggggtagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaag

SEQ ID NO: 8686 - DNA, 1498 bp, Sphingopyxis sp. H005
  ref <308>: DATABASE ACCESSION NUMBER: NCBI ACCESSION: NZ_LNRR01000005.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgaactcttcggagttagtggcgcacgggtgcgtaacgcgtgggaatctgcccttgggtacggaataactcagagaaatttgtgctaataccgtataatgtcttcggaccaaagatttatcgcccaaggatgagcccgcgtaagattagctagttggtggggtaaaagcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcgcgtaggcggttttttaagtcagaggtgaaagcccagtgctcaacactggaactgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggttcatagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctaatcgcggatcgtagagatactttccttcagttcggctggattagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcaactacagtgggcagcaaccgggcgaccggtagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaagga

SEQ ID NO: 8687 - DNA, 1498 bp, Sphingopyxis sp. H012; identical to SEQ ID NO: 8686
  ref <308>: DATABASE ACCESSION NUMBER: NCBI ACCESSION: NZ_LNRS01000002.1
  ref <309>: DATABASE ENTRY DATE: 2019-04-01
  ref <313>: RELEVANT RESIDUES IN SEQ ID NO: (1)..(1498)

SEQ ID NO: 8688 - DNA, 1498 bp, Sphingopyxis sp. H038; identical to SEQ ID NO: 8686
  ref <308>: DATABASE ACCESSION NUMBER: NCBI ACCESSION: NZ_LNRT01000004.1
  ref <309>: DATABASE ENTRY DATE: 2019-04-01
  ref <313>: RELEVANT RESIDUES IN SEQ ID NO: (1)..(1498)

SEQ ID NO: 8689 - DNA, 1498 bp, Sphingopyxis sp. H050
  ref <308>: DATABASE ACCESSION NUMBER: NCBI ACCESSION: NZ_LNRZ01000006.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgaagtcttcggacttagtggcgcacgggtgcgtaacgcgtgggaatctgcccttgggtacggaataactcagagaaatttgtgctaataccgtataatgtcttcggaccaaagatttatcgcccaaggatgagcccgcgtaagattagctagttggtgaggtaaaagctcaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcgcgtaggcggttttttaagtcagaggtgaaagcccggggctcaaccccggaattgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggttcatagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggatagtggagacactttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcaactacagtgggcagcaacctcgcgaggggtagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaagga

SEQ ID NO: 8690 - DNA, 1498 bp, Sphingopyxis sp. H053; identical to SEQ ID NO: 8686
  ref <308>: DATABASE ACCESSION NUMBER: NCBI ACCESSION: NZ_LNRU01000007.1
  ref <309>: DATABASE ENTRY DATE: 2019-04-01
  ref <313>: RELEVANT RESIDUES IN SEQ ID NO: (1)..(1498)

SEQ ID NO: 8691 - DNA, 1498 bp, Sphingopyxis sp. H057
  ref <308>: DATABASE ACCESSION NUMBER: NCBI ACCESSION: NZ_LNSD01000004.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgagaccttcgggtctagtggcgcacgggtgcgtaacgcgtgggaatctgcccttgggtgcggaataactttccgaaaggaatgctaataccgcataatgtcgtaagaccaaagatttatcgcccaaggatgagcccgcgtaagattagctagttggtggggtaaaagcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggatgataatgacagtaccgggagaataagctccggctaacttcgtgccagcagccgcggtaatacgaggggagctagcgttgttcggaattactgggcgtaaagcgcgcgtaggcggctttttaagtcagaggtgaaagcccggggctcaaccccggaatagcctttgaaactggaaagctagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggttcatagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattagagagatcttttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcaactacagtgggcagcaaccgtgcgagcggtagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaagga

SEQ ID NO: 8692 - DNA, 1498 bp, Sphingopyxis sp. H067; identical to SEQ ID NO: 8691
  ref <308>: DATABASE ACCESSION NUMBER: NCBI ACCESSION: NZ_LNSE01000004.1
  ref <309>: DATABASE ENTRY DATE: 2019-04-01
  ref <313>: RELEVANT RESIDUES IN SEQ ID NO: (1)..(1498)

SEQ ID NO: 8693 - DNA, 1498 bp, Sphingopyxis sp. H071; identical to SEQ ID NO: 8691
  ref <308>: DATABASE ACCESSION NUMBER: NCBI ACCESSION: NZ_LNSF01000005.1
  ref <309>: DATABASE ENTRY DATE: 2019-04-01
  ref <313>: RELEVANT RESIDUES IN SEQ ID NO: (1)..(1498)

SEQ ID NO: 8694 - DNA, 1498 bp, Sphingopyxis sp. H073; identical to SEQ ID NO: 8691
  ref <308>: DATABASE ACCESSION NUMBER: NCBI ACCESSION: NZ_LNSG01000006.1
  ref <309>: DATABASE ENTRY DATE: 2019-04-01
  ref <313>: RELEVANT RESIDUES IN SEQ ID NO: (1)..(1498)

SEQ ID NO: 8695 - DNA, 1498 bp, Sphingopyxis sp. H077; identical to SEQ ID NO: 8686
  ref <308>: DATABASE ACCESSION NUMBER: NCBI ACCESSION: NZ_LNRV01000018.1
  ref <309>: DATABASE ENTRY DATE: 2019-04-01
  ref <313>: RELEVANT RESIDUES IN SEQ ID NO: (1)..(1498)

SEQ ID NO: 8696 - DNA, 1498 bp, Sphingopyxis sp. H080; identical to SEQ ID NO: 8686
  ref <308>: DATABASE ACCESSION NUMBER: NCBI ACCESSION: NZ_LNRW01000013.1
  ref <309>: DATABASE ENTRY DATE: 2019-04-01
  ref <313>: RELEVANT RESIDUES IN SEQ ID NO: (1)..(1498)

SEQ ID NO: 8697 - DNA, 1498 bp, Sphingopyxis sp. H081; identical to SEQ ID NO: 8691
  ref <308>: DATABASE ACCESSION NUMBER: NCBI ACCESSION: NZ_LNSH01000005.1
  ref <309>: DATABASE ENTRY DATE: 2019-04-01
  ref <313>: RELEVANT RESIDUES IN SEQ ID NO: (1)..(1498)

SEQ ID NO: 8698 - DNA, 1498 bp, Sphingopyxis sp. H085; identical to SEQ ID NO: 8686
  ref <308>: DATABASE ACCESSION NUMBER: NCBI ACCESSION: NZ_LNRX01000021.1
  ref <309>: DATABASE ENTRY DATE: 2019-04-01
  ref <313>: RELEVANT RESIDUES IN SEQ ID NO: (1)..(1498)

SEQ ID NO: 8699 - DNA, 1498 bp, Sphingopyxis sp. H093; identical to SEQ ID NO: 8686
  ref <308>: DATABASE ACCESSION NUMBER: NCBI ACCESSION: NZ_LNRY01000025.1
  ref <309>: DATABASE ENTRY DATE: 2019-04-01
  ref <313>: RELEVANT RESIDUES IN SEQ ID NO: (1)..(1498)

SEQ ID NO: 8700 - DNA, 1498 bp, Sphingopyxis sp. H100; identical to SEQ ID NO: 8691
  ref <308>: DATABASE ACCESSION NUMBER: NCBI ACCESSION: NZ_LNSI01000005.1
  ref <309>: DATABASE ENTRY DATE: 2019-04-01
  ref <313>: RELEVANT RESIDUES IN SEQ ID NO: (1)..(1498)

SEQ ID NO: 8701 - DNA, 1498 bp, Sphingopyxis sp. H107; identical to SEQ ID NO: 8691
  ref <308>: DATABASE ACCESSION NUMBER: NCBI ACCESSION: NZ_LNSJ01000016.1
  ref <309>: DATABASE ENTRY DATE: 2019-04-01
  ref <313>: RELEVANT RESIDUES IN SEQ ID NO: (1)..(1498)

SEQ ID NO: 8702 - DNA, 1498 bp, Sphingopyxis sp. H115
  ref <308>: DATABASE ACCESSION NUMBER: NCBI ACCESSION: NZ_LNSA01000041.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgaagtcttcggacttagtggcgcacgggtgcgtaacgcgtgggaatctgcccttgggtacggaataactcagagaaatttgtgctaataccgtataatgacttcggtccaaagatttatcgcccaaggatgagcccgcgtaagattagctagttggtggggtaaaagcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttaccagggatgataatgacagtacctggagaataagctccggctaactccgtgccagcagccgcggtaatacggagggagctagcgttgttcggaattactgggcgtaaagcgcgcgtaggcggttttttaagtcagaggtgaaagcccggggctcaaccccggaattgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggttcatagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattagagagatcttttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcaactacagtgggcagcaacctcgcgaggggtagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaagga

SEQ ID NO: 8703 - DNA, 1498 bp, Sphingopyxis sp. HIX
  ref <308>: DATABASE ACCESSION NUMBER: NCBI ACCESSION: NZ_LNSB01000054.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgaagtcttcggacttagtggcgcacgggtgcgtaacgcgtgggaatctgcccttgggtacggaataactcagagaaatttgtgctaataccgtataatgacttcggtccaaagatttatcgcccaaggatgagcccgcgtaagattagctagttggtggggtaaaagcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggatgataatgacagtaccgggagaataagctccggctaactccgtgccagcagccgcggtaatacggagggagctagcgttgttcggaattactgggcgtaaagcgcgcgtaggcggttttttaagtcagaggtgaaagcccggggctcaaccccggaattgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggctcatagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattagagagatcttttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcggtgacagtgggcagcaacctcgcgagaggtagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaagga

SEQ ID NO: 8704 - DNA, 1498 bp, Sphingopyxis sp. HXXIV; identical to SEQ ID NO: 8703
  ref <308>: DATABASE ACCESSION NUMBER: NCBI ACCESSION: NZ_LNSC01000055.1
  ref <309>: DATABASE ENTRY DATE: 2019-04-01
  ref <313>: RELEVANT RESIDUES IN SEQ ID NO: (1)..(1498)

SEQ ID NO: 8705 - DNA, 1498 bp, Sphingopyxis sp. KK2
  ref <308>: DATABASE ACCESSION NUMBER: NCBI ACCESSION: NZ_LYVN01000076.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgaagtcttcggacttagtggcgcacgggtgcgtaacgcgtgggaatctgcccttgggtacggaataactcagagaaatttgtgctaataccgtataatgtcttcggaccaaagatttatcgcccaaggatgagcccgcgtaggattagctagttggtgaggtaaaagctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcgcgtaggcggttttttaagtcagaggtgaaagcccagtgctcaacactggaactgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggctcatagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattagagagatcttttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcggtgacagtgggcagcaaccgggcgaccggtagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaagga

SEQ ID NO: 8706 - DNA, 1498 bp, Sphingopyxis sp. LC363
  ref <308>: DATABASE ACCESSION NUMBER: NCBI ACCESSION: NZ_JNFC01000035.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgaactcttcggagttagtggcgcacgggtgcgtaacgcgtgggaatctgcccttgggtacggaataactcagagaaatttgtgctaataccgtataatgacttcggtccaaagatttatcgcccaaggatgagcccgcgtaagattagctagttggtggggtaaaagcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcgcgtaggcggttttttaagtcagaggtgaaagcccggggctcaaccccggaattgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggttcatagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattagagagatcttttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcaactacagtgggcagcaacctcgcgaggggtagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaagga

SEQ ID NO: 8707 - DNA, 1498 bp, Sphingopyxis sp. LC81
  ref <308>: DATABASE ACCESSION NUMBER: NCBI ACCESSION: NZ_JNFD01000035.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgaagtcttcggacttagtggcgcacgggtgcgtaacgcgtgggaatctgcccttgggtacggaataactcagagaaatttgtgctaataccgtataatgtcttcggaccaaagatttatcgcccaaggatgagcccgcgtaagattagctagttggtggggtaaaagcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcgcgtaggcggttttttaagtcagaggtgaaagcccagtgctcaacactggaactgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggttcatagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattagagagatcttttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcaactacagtgggcagcaacctcgcgaggggtagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaagga

SEQ ID NO: 8708 - DNA, 1500 bp, Sphingopyxis sp. LPB0140
  ref <308>: DATABASE ACCESSION NUMBER: NCBI ACCESSION: NZ_CP018154.1
  ref <309>: DATABASE ENTRY DATE: 2019-04-01
  ref <313>: RELEVANT RESIDUES IN SEQ ID NO: (1)..(1500)
tcaaacttgagagtttgatcctggctcagaacgaacgctggcggcatgcttaacacatgcaagtcgaacgagaccttcgggtctagtggcgcacgggtgcgtaacgcgtgggaatctaccttttgctacggaataactcagagaaatttgtgctaataccgtataatgtcgtaagaccaaagatttatcggcaaaagatgagcccgcgtaagattagctagttggtggggtaagagctcaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttcgggttgtaaagctcttttactagggatgataatgacagtacctagagaataagctccggctaactccgtgccagcagccgcggtaatacggagggagctagcgttgttcggaattactgggcgtaaagcgcgcgtaggcggctattcaagtcagaggtgaaagcctggagctcaactccagaactgcctttgaaactagatagctagaatcttggagaggtgagtggaattccgagtgtagaggtgaaattcgtagatattcggaagaacaccagtggcgaaggcgactcactggccaagaattgacgctgaggtgcgaaagcgtggggagcaaacaggattagataccctggtagtccacgccgtaaacgatgataactagctgttcgaacccacagggtttgagtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatacctatcgcggatttcagagatgatttccttcagttcggctggataggatacaggtgctgcatggctgtcgtcagctcgtgtcgtgagatgttgggttaagtcccgcaacgagcgcaaccctcatccttagttgccatcatttagttgggcactctaaggaaactgccggtgataagccggaggaaggtggggatgacgtcaagtcctcatggcccttacacgctgggctacacacgtgctacaatggcggtgacagtgggcagcaacctcgcgagaggtagctaatctccaaaagccgtctcagttcggattgctctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaacctagcaataggaggcaggcgaccacggtgggtttagcgactggggtgaagtcgtaacaaggtagccgtaggggaacctgcggctggatcacctcctttctaagga

SEQ ID NO: 8709 - DNA, 1498 bp, Sphingopyxis sp. MC1; identical to SEQ ID NO: 8682
  ref <308>: DATABASE ACCESSION NUMBER: NCBI ACCESSION: NZ_AOUN01000003.1
  ref <309>: DATABASE ENTRY DATE: 2019-04-01
  ref <313>: RELEVANT RESIDUES IN SEQ ID NO: (1)..(1498)

SEQ ID NO: 8710 - DNA, 1495 bp, Sphingopyxis sp. MG
  ref <308>: DATABASE ACCESSION NUMBER: NCBI ACCESSION: NZ_CP026381.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgaagtcttcggacttagtggcgcacgggtgcgtaacgcgtgggaatctacccttgggtacggaataactcagagaaatttgtgctaataccgtataatgacttcggtccaaagatttatcgcccaaggatgagcccgcgtaagattagctagttggtggggtaaaagcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggatgataatgacagtaccgggagaataagctccggctaactccgtgccagcagccgcggtaatacggagggagctagcgttgttcggaattactgggcgtaaagcgcgcgtaggcggttttccaagtcaggggtgaaagcccggggctcaaccccggaatagcccttgaaactggaagactagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggttcatagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggttaccagagatggtttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcggtgacagtgggcagcaactccgcgaggagtagctaatctccaaaaaccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaag

SEQ ID NO: 8711 - DNA, 1498 bp, Sphingopyxis sp. MWB1
  ref <308>: DATABASE ACCESSION NUMBER: NCBI ACCESSION: NZ_JQFJ01000002.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgaagtcttcggacttagtggcgcacgggtgcgtaacgcgtgggaatctgcccttgggtacggaataactcggagaaattcgtgctaataccgtataatgtcttcggaccaaagatttatcgcccaaggatgagcccgcgtaggattagctagttggtgaggtaaaagctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttaccagggatgataatgacagtacctggagaataagctccggctaactccgtgccagcagccgcggtaatacggagggagctagcgttgttcggaattactgggcgtaaagcgcgcgtaggcggttttttaagtcagaggtgaaagcccggggctcaaccccggaatagcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactatctgtccggactcatagagtttgggtggagcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatccttgtcgcggataccagagatggtttccttcagttcggctggacaagtgacaggtgctgcatggctgtcgtcagctcgtgtcgtgagatgttgggttaagtcccgcaacgagcgcaaccctcatccctagttgccagcattcagttgggcactctaaggaaactgccggtgataagccggaggaaggtggggatgacgtcaagtcctcatggcccttacgcgctgggctacacacgtgctacaatggcggtgacagtgggcagcaacctcgcgagaggtagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaagga

SEQ ID NO: 8712 - DNA, 1498 bp, Sphingopyxis sp. QXT-31
  ref <308>: DATABASE ACCESSION NUMBER: NCBI ACCESSION: NZ_CP019449.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgaagtcttcggacttagtggcgcacgggtgcgtaacgcgtgggaatctgcccttgggtacggaataactcagagaaatttgtgctaataccgtataatgtcttcggaccaaagatttatcgcccaaggatgagcccgcgtaagattagctagttggtgaggtaaaagctcaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggatgataatgacagtaccgggagaataagctccggctaactccgtgccagcagccgcggtaatacggagggagctagcgttgttcggaattactgggcgtaaagcgcgcgtaggcggttttttaagtcagaggtgaaagcccagtgctcaacactggaactgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggctcatagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattagagagatcttttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcggtgacagtgggcagcaacctcgcgagaggtagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaagga

SEQ ID NO: 8713 - DNA, 1498 bp, Sphingopyxis sp. Root1497
  ref <308>: DATABASE ACCESSION NUMBER: NCBI ACCESSION: NZ_LMGF01000003.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgaagtcttcggacttagtggcgcacgggtgcgtaacgcgtgggaatctgcccttgggtacggaataactcagagaaatttgtgctaataccgtataatgtcttcggaccaaagatttatcgcccaaggatgagcccgcgtaagattagctagttggtgaggtaagagctcaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcgcgtaggcggttttttaagtcagaggtgaaagcccagtgctcaacactggaactgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggctcatagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattagagagatcttttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcggtgacagtgggcagcaaccgggcgaccggtagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaagga

SEQ ID NO: 8714 - DNA, 1498 bp, Sphingopyxis sp. Root154
  ref <308>: DATABASE ACCESSION NUMBER: NCBI ACCESSION: NZ_LMGI01000002.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgaactcttcggagttagtggcgcacgggtgcgtaacgcgtgggaatctgcccttgggtacggaataactcagagaaatttgtgctaataccgtataatgtcttcggaccaaagatttatcgcccaaggatgagcccgcgtaagattagctagttggtggggtaaaagcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcgcgtaggcggttttttaagtcagaggtgaaagcccagtgctcaacactggaactgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggttcatagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattagagagatcttttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcaactacagtgggcagcaaccgggcgaccggtagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaagga

SEQ ID NO: 8715 - DNA, 1418 bp, Sphingopyxis sp. Root214
  misc_feature (4)..(4): n is a, c, g, or t
  misc_feature (644)..(644): n is a, c, g, or t
  ref <308>: DATABASE ACCESSION NUMBER: NCBI ACCESSION: NZ_LMIG01000004.1
  ref <309>: DATABASE ENTRY DATE: 2019-04-01
  ref <313>: RELEVANT RESIDUES IN SEQ ID NO: (1)..(1418)
aatntggctcagaacgaacgctggcggcatgcctaacacatgcaagtcgaacgaactcttcggagttagtggcgcacgggtgcgtaacgcgtgggaatctgcccttgggtacggaataactcagagaaatttgtgctaataccgtataatgtcttcggaccaaagatttatcgcccaaggatgagcccgcgtaagattagctagttggtggggtaaaagcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcgcgtaggcggttttttaagtcagaggtgaaagcccagtgctcaacactggaactgcctttgaaactggaaaacttgaatcttggagaggtcagtggaattccgagtgtagaggtgaaattcgtagatattcggaaganaaacaggattagataccctggtagtccacgccgtaaacgatgataactagctgtccgggttcatagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggattagagagatcttttccttcagttcggctggatcagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcaactacagtgggcagcaaccgggcgaccggtagctaatctccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaagga

SEQ ID NO: 8716 - DNA, 1495 bp, Sphingopyxis sp. WS5A3p
  ref <308>: DATABASE ACCESSION NUMBER: NCBI ACCESSION: NZ_CM009578.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgaactcttcggagttagtggcgcacgggtgcgtaacgcgtgggaatctgcccttgggtacggaataactcagagaaatttgtgctaataccgtataatgacttcggtccaaagatttatcgcccaaggatgagcccgcgtaagattagctagttggtggggtaaaagcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggatgataatgacagtaccgggagaataagctccggctaactccgtgccagcagccgcggtaatacggagggagctagcgttgttcggaattactgggcgtaaagcgcgcgtaggcggctttttaagtcagaggtgaaagcccggggctcaaccccggaatagcctttgaaactggaaagctagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactatctgtccgggctcatagagcttgggtggagcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatccttgtcgcggtttccagagatggattccttcagttcggctggacaagtgacaggtgctgcatggctgtcgtcagctcgtgtcgtgagatgttgggttaagtcccgcaacgagcgcaaccctcatccctagttgccatcattcagttgggcactctaaggaaactgccggtgataagccggaggaaggtggggatgacgtcaagtcctcatggcccttacgcgctgggctacacacgtgctacaatggcggtgacagtgggcagcaaccgagcgatcggtagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaag

SEQ ID NO: 8717 - DNA, 1495 bp, Sphingopyxis terrae
  ref <308>: DATABASE ACCESSION NUMBER: NCBI ACCESSION: NZ_FXWL01000004.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgagatcttcggatctagtggcgcacgggtgcgtaacgcgtgggaatctgcccttgggtacggaataactcagagaaatttgtgctaataccgtataatgtcttcggaccaaagatttatcgcccaaggatgagcccgcgtaggattagctagttggtgaggtaaaagctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggatgataatgacagtaccgggagaataagctccggctaacttcgtgccagcagccgcggtaatacgaggggagctagcgttgttcggaattactgggcgtaaagcgcgcgtaggcggttttttaagtcagaggtgaaagcccggggctcaaccccggaattgcctttgaaactggaaaactagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggttcatagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctgatcgcggttaccagagatggtttccttcagttcggctggatcagtgacaggtgctgcatggctgtcgtcagctcgtgtcgtgagatgttgggttaagtcccgcaacgagcgcaaccctcatccctagttgccatcattaagttgggcactctaaggaaactgccggtgataagccggaggaaggtggggatgacgtcaagtcctcatggcccttacgcgctgggctacacacgtgctacaatggcggtgacagtgggcagcaacctcgcgagaggtagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcagtgctctaacccgcaagggaggaagctgaccacggtgggatcagcgactggggtgaagtcgtaacaaggtagccgtaggggaacctgcggctggatcacctcctttctaag

SEQ ID NO: 8718 - DNA, 1496 bp, Sphingorhabdus marina
  ref <308>: DATABASE ACCESSION NUMBER: NCBI ACCESSION: NZ_FSQW01000002.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcttaacacatgcaagtcgaacgagatcttcggatctagtggcgcacgggtgcgtaacgcgtggggatctaccatagggtacggaataactcagagaaatttgtgctaataccgtataatgtcgcaagaccaaagatttatcgccctttgatgaacccgcgtaagattagcttgttggtgaggtaaaggctcaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccctagggtcgtaaagctcttttaccagggatgataatgacagtacctggagaataagctccggctaactccgtgccagcagccgcggtaatacggagggagctagcgttgttcggaattactgggcgtaaagcgcgcgtaggcggctattcaagtcagaggtgaaatcccggagctcaactccggaactgcctttgaaactagatagctagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgctagggcccacagggctttggtggcgcagctaacgcattaagttatccgcctggggagtacggtcgcaagattaaaactcaaaggaattgacgggggcctgcacaagcggtggagcatgtggtttaattcgacgcaacgcgcagaaccttaccagcgtttgacatcctaatcgcggatttcagagatgatttccttcagttcggctggattagtgacaggtgctgcatggctgtcgtcagctcgtgtcgtgagatgttgggttaagtcccgcaacgagcgcaacccctatcattagttgctaccatttagttgggcactctaatgagaccgccggtgataagccggaggaaggtggggatgacgtcaagtcctcatggcccttacacgctgggctacacacgtgctacaatggcggtgacagtgggcagctacttcgcgagaagatgctaatctctaaaaaccgtctcagttcggattgttctctgcaactcgagagcatgaaggcggaatcgctagtaatcgcagatcagcatgctgcggtgaatacgttcccaggccttgtacacaccgcccgtcacaccatgggagttggatcaacccgaagctggtgcgctaaccttttggaggcagccaaccacggtgggttcagcgactggggtgaagtcgtaacaaggtagccgtaggggaacctgcggctggatcacctcctttctaagga

SEQ ID NO: 8719 - DNA, 1495 bp, Sphingorhabdus sp. Alg231-15
  ref <308>: DATABASE ACCESSION NUMBER: NCBI ACCESSION: NZ_LT703001.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcttaacacatgcaagtcgaacgagatcttcggatctagtggcgcacgggtgcgtaacgcgtggggatctaccaaagggtacggaataactcagagaaatttgtgctaataccgtataatgtcgcaagaccaaagatttatcgccctttgatgaacccgcgtaagattagcttgttggtgaggtaaaggctcaccaaggcgacgatctttagctggtctgagaggatgatcagccacactgggactgagacacggcccagactcctacgggaggcagcagtggggaatattggacaatgggggaaaccctgatccagcaatgccgcgtgagtgatgaaggccttagggtcgtaaagctcttttactagggatgataatgacagtacctagagaataagctccggctaactccgtgccagcagccgcggtaatacggagggagctagcgttgttcggaattactgggcgtaaagcgcgcgtaggcggttcgataagtcagaggtgaaatcccggagctcaactccggaactgcctttgaaactgacgaactagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgctagggcccacagggctttggtggcgcagctaacgcattaagttatccgcctggggagtacggtcgcaagattaaaactcaaaggaattgacgggggcctgcacaagcggtggagcatgtggtttaattcgacgcaacgcgcagaaccttaccagcgtttgacatcctaatcgcgaatttcagagatgattttcttcagttcggctggattagtgacaggtgctgcatggctgtcgtcagctcgtgtcgtgagatgttgggttaagtcccgcaacgagcgcaacccctatctttagttgctaccatttagttgggcactctaaagagaccgccggtgataagccggaggaaggtggggatgacgtcaagtcctcatggcccttacacgctgggctacacacgtgctacaatggcggtgacagtgggcagctacttcgcgagaagatgctaatctctaaaaaccgtctcagttcggattgttctctgcaactcgagagcatgaaggcggaatcgctagtaatcgcagatcagcatgctgcggtgaatacgttcccaggccttgtacacaccgcccgtcacaccatgggagttggatcaacccgaagctagtgcgctaactcgcaagagaggcagctaaccacggtgggttcagcgactggggtgaagtcgtaacaaggtagccgtaggggaacctgcggctggatcacctcctttctaag

SEQ ID NO: 8720 - DNA, 1493 bp, Sphingorhabdus sp. EL138
  ref <308>: DATABASE ACCESSION NUMBER: NCBI ACCESSION: NZ_OGVD01000001.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcttaacacatgcaagtcgaacgagatcttcggatctagtggcgcacgggtgcgtaacgcgtggggatctaccaaagggtacggaataactcagagaaatttgtgctaataccgtataatgtcgcaagaccaaagatttatcgccctttgatgaacccgcgtaagattagcttgttggtgaggtaaaggctcaccaaggcgacgatctttagctggtctgagaggatgatcagccacactgggactgagacacggcccagactcctacgggaggcagcagtggggaatattggacaatgggggaaaccctgatccagcaatgccgcgtgagtgatgaaggccttagggtcgtaaagctcttttactagggatgataatgacagtacctagagaataagctccggctaactccgtgccagcagccgcggtaatacggagggagctagcgttgttcggaattactgggcgtaaagcgcgcgtaggcggttacacaagtcagaggtgaaatcccggagctcaactccggaactgcctttgaaactaggtaactagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgctagggcccacagggctttggtggcgcagctaacgcattaagttatccgcctggggagtacggtcgcaagattaaaactcaaaggaattgacgggggcctgcacaagcggtggagcatgtggtttaattcgacgcaacgcgcagaaccttaccagcgtttgacatcctaatcgcgaatttcagagatgattttcttcagttcggctggattagtgacaggtgctgcatggctgtcgtcagctcgtgtcgtgagatgttgggttaagtcccgcaacgagcgcaacccctatctttagttgctaccatttagttgggcactctaaagagaccgccggtgataagccggaggaaggtggggatgacgtcaagtcctcatggcccttacacgctgggctacacacgtgctacaatggcggtgacagtgggcagctacttcgcgagaagatgctaatctctaaaaaccgtctcagttcggattgttctctgcaactcgagagcatgaaggcggaatcgctagtaatcgcagatcagcatgctgcggtgaatacgttcccaggccttgtacacaccgcccgtcacaccatgggagttggatcaacccgaagctagtgcgctaaccgcaaggaggcagctaaccacggtgggttcagcgactggggtgaagtcgtaacaaggtagccgtaggggaacctgcggctggatcacctcctttctaag

SEQ ID NO: 8721 - DNA, 1498 bp, Sphingorhabdus sp. M41
  ref <308>: DATABASE ACCESSION NUMBER: NCBI ACCESSION: NZ_CP014545.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcttaacacatgcaagtcgaacgagatcttcggatctagtggcgcacgggtgcgtaacgcgtggggatctaccatagggtgcggaataactcagagaaatttgagctaataccgcataatgtcttcggaccaaagatttatcgccctttgatgaacccgcgtaagattagcttgttggtgaggtaaaggctcaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggttactcaagtcagaggtgaaagcccggagctcaactccggaactgcctttgaaactaggtgactagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgctagggcccacagggctttggtggcgcagctaacgcattaagttatccgcctggggagtacggtcgcaagattaaaactcaaaggaattgacgggggcctgcacaagcggtggagcatgtggtttaattcgacgcaacgcgcagaaccttaccagcgtttgacatcctgatcgcggattagagagatcttttccttcagctcggctggatcagtgacaggtgctgcatggctgtcgtcagctcgtgtcgtgagatgttgggttaagtcccgcaacgagcgcaacccctatctttagttgccaccatttagttgggcactctaaagagaccgccggtgataagccggaggaaggtggggatgacgtcaagtcctcatggcccttacacgctgggctacacacgtgctacaatggcggtgacagtgggcagctacttcgcgagaagatgctaatctctaaaaaccgtctcagttcggattgttctctgcaactcgagagcatgaaggcggaatcgctagtaatcgcggatcagcatgccgcggtgaatacgttcccaggccttgtacacaccgcccgtcacaccatgggagttggatcaacccgaagctggtgcgctaactcgcaagagaggcagccaaccacggtgggttcagcgactggggtgaagtcgtaacaaggtagccgtaggggaacctgcggctggatcacctcctttctaagga

SEQ ID NO: 8722 - DNA, 1495 bp, Sphingorhabdus sp. YGSMI21
  ref <308>: DATABASE ACCESSION NUMBER: NCBI ACCESSION: NZ_CP022548.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcttaacacatgcaagtcgaacgagatcttcggatctagtggcgcacgggtgcgtaacgcgtggggatctaccatagggtgcggaataactcagagaaatttgagctaataccgcataatgtcttcggaccaaagatttatcgccctttgatgaacccgcgtaagattagcttgttggtgaggtaaaggctcaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggttactcaagtcagaggtgaaagcccggagctcaactccggaactgcctttgaaactaggtgactagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgctagggcccacagggctttggtggcgcagctaacgcattaagttatccgcctggggagtacggtcgcaagattaaaactcaaaggaattgacgggggcctgcacaagcggtggagcatgtggtttaattcgacgcaacgcgcagaaccttaccagcgtttgacatcctgatcgcggatttgagagatcatttccttcagctcggctggatcagtgacaggtgctgcatggctgtcgtcagctcgtgtcgtgagatgttgggttaagtcccgcaacgagcgcaacccctatctttagttgctaccatttggttgggcactctaaagagaccgccggtgataagccggaggaaggtggggatgacgtcaagtcctcatggcccttacacgctgggctacacacgtgctacaatggcggtgacagtgggcagctacttcgcgagaagatgctaatctctaaaaaccgtctcagttcggattgttctctgcaactcgagagcatgaaggcggaatcgctagtaatcgcggatcagcatgccgcggtgaatacgttcccaggccttgtacacaccgcccgtcacaccatgggagttggatcaacccgaagctggtgcgctaactcgcaagagaggcagccaaccacggtgggttcagcgactggggtgaagtcgtaacaaggtagccgtaggggaacctgcggctggatcacctcctttctaag

SEQ ID NO: 8723 - DNA, 1493 bp, Sphingorhabdus wooponensis
  ref <308>: DATABASE ACCESSION NUMBER: NCBI ACCESSION: NZ_RWJI01000001.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcttaacacatgcaagtcgaacgagaccttcgggtctagtggcgcacgggtgcgtaacgcgtgggaatctgcccttaggtacggaataactcagagaaatttgtgctaataccgtatgatgtcgaaagaccaaagatttatcgcctaaggatgagcccgcgtaagattagcttgttggtgaggtaaaagctcaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagagtacgtaggcggttattcaagtcagaggtgaaagcctggagctcaactccagaactgcctttgaaactagatagctagaatcttggagaggtgagtggaattccgagtgtagaggtgaaattcgtagatattcggaagaacaccagtggcgaaggcgactcactggacaagtattgacgctgaggtacgaaagcgtggggagcaaacaggattagataccctggtagtccacgccgtaaacgatgataactagctgttcgggctctacgagcttgagtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcctaatcgcggttttcagagatgattaccttcagttcggctggattagtgacaggtgctgcatggctgtcgtcagctcgtgtcgtgagatgttgggttaagtcccgcaacgagcgcaaccctcgtccttagttgccatcattcagttgggcactctaaggaaactgccggtgataagccggaggaaggtggggatgacgtcaagtcctcatggcccttacacgctgggctacacacgtgctacaatggcggtgacagtgggcagcaaccgggcgaccggtagctaatctccaaaaaccgtctcagttcggattgttctctgcaactcgagagcatgaaggcggaatcgctagtaatcgcggatcagcatgccgcggtgaatacgttcccaggccttgtacacaccgcccgtcacaccatgggatttggattcacccgaaggcagtgcgctaaccgcaaggaggcagctgaccacggtgggtttagagactggggtgaagtcgtaacaaggtagccgtaggggaacctgcggctggatcacctcctttctaag

SEQ ID NO: 8724 - DNA, 1491 bp, Sphingosinicella microcystinivorans
  ref <308>: DATABASE ACCESSION NUMBER: NCBI ACCESSION: NZ_AP018711.1
  ref <309>: DATABASE ENTRY DATE: 2019-04-01
  ref <313>: RELEVANT RESIDUES IN SEQ ID NO: (1)..(1491)
aacttgagagtttgatcctggctcagaacgaacgctggcggcatgcctaacacatgcaagtcgaacgaagccttcgggcttagtggcgcacgggtgcgtaacacgtgggaatctgcccttaggtacggaataacagttagaaatgactgctaataccgtatgatgactccggtccaaagatttatcgcctaaggatgagcccgcgtcggattagctagttggtgaggtaaaggctcaccaaggcgacgatccgtagctggtctgagaggatgatcagccacactgggactgagacacggcccagactcctacgggaggcagcagtggggaatattggacaatgggcgaaagcctgatccagcaatgccgcgtgagtgaagaaggccttagggttgtaaagctcttttacccgggatgataatgacagtaccgggagaataagctccggctaactccgtgccagcagccgcggtaatacggagggagctagcgttgttcggaatcactgggcgtaaagcgcacgtaggcggctttgtaagttagaggtgaaagcccggggctcaactccggaactgcctttaagactgcatcgcttgaatctgggagaggtaagtggaattccgagtgtagaggtgaaattcgtagatattcggaagaacaccagtggcgaaggcggcttactggaccagaattgacgctgaggtgcgaaagcgtggggagcaaacaggattagataccctggtagtccacgccgtaaacgatgagaactagctgtcagggccttttaggctttggtggcgcagctaacgcattaagttctccgcctggggagtacggtcgcaagattaaaactcaaaggaattgacgggggcctgcacaagcggtggagcatgtggtttaattcgaagcaacgcgcagaaccttaccagcgtttgacatcctgatcgcggttaccagagatggtttccttcagttcggctggatcagtgacaggtgctgcatggctgtcgtcagctcgtgtcgtgagatgttgggttaagtcccgcaacgagcgcaaccctcgtccttagttgccatcattcagttgggcactctaaggaaaccgccggtgataagccggaggaaggtggggatgacgtcaagtcctcatggcccttacgcgctgggctacacacgtgctacaatggcggtgacagtgggcagcaaacccgcgagggtgagctaatctccaaaagccgtctcagttcggattgttctctgcaactcgagagcatgaaggcggaatcgctagtaatcgcggatcagcatgccgcggtgaatacgttccgaggccttgtacacaccgcccgtcacaccatgggagttggtttcacccgaaggctgtgcgctaaccgcaaggaggcagcagaccacggtgggatcagcgactggggtgaagtcgtaacaaggtagccgtaggggaacctgcggctggatcacctcctttctaag

SEQ ID NO: 8725 - DNA, 1494 bp, Sphingosinicella sp. BN140058
  ref <308>: DATABASE ACCESSION NUMBER: NCBI ACCESSION: NZ_CP035501.1
  ref <309>: DATABASE ENTRY DATE: 2019-04-01
  ref <313>: RELEVANT RESIDUES IN SEQ ID NO: (1)..(1494)
aaacttgagagtttgattctggctcagaacgaacgctggcggcatgcctaacacatgcaagtcgaacgagaccttcgggtctagtggcgcacgggtgcgtaacgcgtgggaatctgcccaaaggttcggaataactcggggaaacccgtgctaataccggatgatatcgcgagatcaaagatttatcgcctttggatgagcccgcgtaggattagcttgttggtggggtaaaggcctaccaaggcgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagttaggggtgaaagcctggagctcaacttcagaattgcccttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcaggggtcttggacttttggtggcgcagctaacgcattaagttatccgcctggggagtacggccgcaaggttaaaactcaaagaaattgacgggggcctgcacaagcggtggagcatgtggtttaattcgaagcaacgcgcagaaccttaccagcgtttgacatcctcatcgcggattccagagatggtttccttcagttcggctggatgagtgacaggtgctgcatggctgtcgtcagctcgtgtcgtgagatgttgggttaagtcccgcaacgagcgcaaccctcgtctttagttgccatcatttagttgggcactctaaagaaaccgccggtgataagccggaggaaggtggggatgacgtcaagtcctcatggcccttacgcgctgggctacacacgtgctacaatggcggtgacagtgggcagcgaacctgcgagggtgagctaatctccaaaagccgtctcagttcggattgttctctgcaactcgagagcatgaaggcggaatcgctagtaatcgcggatcagcacgccgcggtgaatacgttcccaggccttgtacacaccgcccgtcacaccatgggagttggattgacccgaaggcagtgagctaacccgcaagggaggcagctgaccacggtcggttcagcgactggggtgaagtcgtaacaaggtagccgtaggggaacctgcggctggatcacctcctttctaag

SEQ ID NO: 8726 - DNA, 1493 bp, Sphingosinicella sp. CPCC 101087
  ref <308>: DATABASE ACCESSION NUMBER: NCBI ACCESSION: NZ_SBFF01000005.1
  ref <309>: DATABASE ENTRY DATE: 2019-04-01
  ref <313>: RELEVANT RESIDUES IN SEQ ID NO: (1)..(1493)
aacttgagagtttgattctggctcagaacgaacgctggcggcatgcctaacacatgcaagtcgaacgagaccttcgggtctagtggcgcacgggtgcgtaacgcgtgggaatctgcccaaaggttcggaataactcggggaaacccgagctaataccggataatgtcttcggaccaaagatttattgcctttggatgagcccgcgtcggattagctagttggtgaggtaaaggctcaccaaggcgacgatccgtagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcgcgtaggcggctttgtaagttagaggtgaaagcccggggctcaactccggaattgcctttaagactgcatcgctagaatccgggagaggtgagtggaattccgagtgtagaggtgaaattcgtagatattcggaagaacaccagtggcgaaggcggctcactggaccggcattgacgctgaggtgcgaaagcgtggggagcaaacaggattagataccctggtagtccacgccgtaaacgatgatgactagctgtcgggggccttaggctttcggtggcgcagctaacgcattaagtcatccgcctggggagtacggccgcaaggttaaaactcaaagaaattgacgggggcctgcacaagcggtggagcatgtggtttaattcgaagcaacgcgcagaaccttaccagcgtttgacatcccggtcgcggattccagagatggattccttcagttcggctggaccggtgacaggtgctgcatggctgtcgtcagctcgtgtcgtgagatgttgggttaagtcccgcaacgagcgcaaccctcgtctttagttgccatcatttagttgggcactctaaagaaaccgccggtgataagccggaggaaggtggggatgacgtcaagtcctcatggcccttacgcgctgggctacacacgtgctacaatggcggtgacagcgggtcgcaacctcgcgaggggtagctaatcccgaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattgacccgaaggtggtgagctaacccgcaagggaggcagccaaccacggtcggttcagcgactggggtgaagtcgtaacaaggtagccgtaggggaacctgcggctggatcacctcctttctaag

SEQ ID NO: 8727 - DNA, 1494 bp, Sphingosinicella sp. GL-C-18
  ref <308>: DATABASE ACCESSION NUMBER: NCBI ACCESSION: NZ_PXYI01000021.1
  ref <309>: DATABASE ENTRY DATE: 2019-04-01
  ref <313>: RELEVANT RESIDUES IN SEQ ID NO: (1)..(1494)
aaacttgagagtttgattctggctcagaacgaacgctggcggcatgcctaacacatgcaagtcgaacgagaccttcgggtctagtggcgcacgggtgcgtaacgcgtgggaatctgcccaaaggttcggaataactcggggaaacccgtgctaataccggatgatatcgcgagatcaaagatttatcgcctttggatgagcccgcgtaggattagcttgttggtggggtaaaggcctaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagttaggggtgaaagcctggagctcaacttcagaattgcccttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcaggggtcttagacttttggtggcgcagctaacgcattaagttatccgcctggggagtacggccgcaaggttaaaactcaaagaaattgacgggggcctgcacaagcggtggagcatgtggtttaattcgaagcaacgcgcagaaccttaccagcgtttgacatcctcatcgcggatttcagagatgatttccttcagttcggctggatgagtgacaggtgctgcatggctgtcgtcagctcgtgtcgtgagatgttgggttaagtcccgcaacgagcgcaaccctcgtctttagttgccatcatttagttgggcactctaaagaaaccgccggtgataagccggaggaaggtggggatgacgtcaagtcctcatggcccttacgcgctgggctacacacgtgctacaatggcggtgacagtgggcagcgaacctgcgagggtgagctaatctccaaaagccgtctcagttcggattgttctctgcaactcgagagcatgaaggcggaatcgctagtaatcgcggatcagcacgccgcggtgaatacgttcccaggccttgtacacaccgcccgtcacaccatgggagttggattgacccgaaggcagtgagctaacccgcaagggaggcagctgaccacggtcggttcagcgactggggtgaagtcgtaacaaggtagccgtaggggaacctgcggctggatcacctcctttctaag

SEQ ID NO: 8728 - DNA, 1493 bp, Sphingosinicella sp. QZX222
  ref <308>: DATABASE ACCESSION NUMBER: NCBI ACCESSION: NZ_QFFF01000001.1
  ref <309>: DATABASE ENTRY DATE: 2019-04-01
  ref <313>: RELEVANT RESIDUES IN SEQ ID NO: (1)..(1493)
aacttgagagtttgattctggctcagaacgaacgctggcggcatgcctaacacatgcaagtcgaacgaaccctttggggttagtggcgcacgggtgcgtaacacgtgggaatctgcccttaggttcggaataacagttagaaatgactgctaataccggatgatgacttcggtccaaagatttatcgcctaaggatgagcccgcgcaggattagctagttggtgaggtaaaggctcaccaaggctacgatccttagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagttagaggtgaaagcccggggctcaaccccggaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcagggctcatagagttttggtggcgcagctaacgcattaagttatccgcctggggagtacggccgcaaggttaaaactcaaagaaattgacgggggcctgcacaagcggtggagcatgtggtttaattcgaagcaacgcgcagaaccttaccagcgtttgacatcctgatcgcgggttccagagatggatcccttcagttcggctggatcagtgacaggtgctgcatggctgtcgtcagctcgtgtcgtgagatgttgggttaagtcccgcaacgagcgcaaccctcgtctttagttgccatcatttagttgggcactctaaagaaaccgccggtgataagccggaggaaggtggggatgacgtcaagtcctcatggcccttacgcgctgggctacacacgtgctacaatggcgactacagtgggcagctatcccgcgagggtgagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggattgacccgaaggcagtgagctaacccgcaagggaggcagctgaccacggtcggttcagcgactggggtgaagtcgtaacaaggtagccgtaggggaacctgcggctggatcacctcctttctaag

SEQ ID NO: 8729 - DNA, 1493 bp, Sphingosinicella vermicomposti
  ref <308>: DATABASE ACCESSION NUMBER: NCBI ACCESSION: NZ_PXYJ01000004.1
  ref <309>: DATABASE ENTRY DATE: 2019-04-01
  ref <313>: RELEVANT RESIDUES IN SEQ ID NO: (1)..(1493)
aacttgagagtttgattctggctcagaacgaacgctggcggcatgcttaacacatgcaagtcgaacgagaccttcgggtctagtggcgcacgggtgcgtaacgcgtgggaatctacccttaggttcggaataacagttagaaatgactgctaataccggatgatgacttcggtccaaagatttatcgcctagggatgagcccgcgtaggattagcttgttggtgaggtaaaagctcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggctttgtaagttagaggtgaaagcccggagctcaactccggaactgcctttaagactgcatcgctagaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcagggctcatggagctttggtggcgcagctaacgcattaagttatccgcctggggagtacggccgcaaggttaaaactcaaagaaattgacgggggcctgcacaagcggtggagcatgtggtttaattcgaagcaacgcgcagaaccttaccagcgtttgacatcctcatcgcggattccagagatggtttccttcagttcggctggatgagtgacaggtgctgcatggctgtcgtcagctcgtgtcgtgagatgttgggttaagtcccgcaacgagcgcaaccctcgtccttagttgccatcatttagttgggcactctaaggaaactgccggtgataagccggaggaaggtggggatgacgtcaagtcctcatggcccttacacgctgggctacacacgtgctacaatggcgactacagtgggcagcgaacctgcgagggtgagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgctaactcgcaagagaggcaggcgaccacggtgggtttagcgactggggtgaagtcgtaacaaggtagccgtaggggaacctgcggctggatcacctcctttctaag

SEQ ID NO: 8730 - DNA, 1524 bp, Spiroplasma clarkii
  ref <308>: DATABASE ACCESSION NUMBER: NCBI ACCESSION: NZ_CP024870.1
  ref <309>: DATABASE ENTRY DATE: 2019-04-01
  ref <313>: RELEVANT RESIDUES IN SEQ ID NO: (1)..(1524)
ttttaatgagagtttgatcctggctcaggatgaacgctggcggcatgcctaatacatgcaagtcgaacggggtgcttgcacccagtggcgaacgggtgagtaacacgtatctaatctaccttttagtgggggataacagttggaaacgactgctaataccgcatgtgacgtcactatggcatcagaagacgttgaaaggcccgtttgggccgctagaagatgaggatgcggcgtattagctagtaggtgaggtaattgctcacctaggcaatgatacgtagccgaactgagaggttgatcggccacattgggactgagatacggcccagacttctacggaaggcagcagtagggaatttttcacaatgggcgaaagcctgatgaagcaatgccgcgtgagtgatgacggtcttcggattgtaaagctctgttgtaagggaagaaatgctagaagaggaaatgcttttagtttgacggtaccttaccagaaagccacggctaactatgtgccagcagccgcggtaatacataggtggcaagcgttatccggatttattgggcgtatagggtgcgtaggcggttagttaagtttgaggttaaagcccggagctcaactccggttcgccttgaaaactggctgactagaatacaggagaggtagatggaattccatgtgtagcggtgaaatgcgtagatatatggaggaacaccagtggcgtaggcggtctactggcctgttattgacgctgaggcacgaaagcgtggggagcaaataggattagataccctagtagtccacgccgtaaacgttgagtactaagtgtcggcatacgtcggtgctgcagctaacgcattaagtactccgcctgagtagtatgctcgcaagagtgaaactcaaaggaattgacggggacccgcacaagtggtggagcatgtggtttaattcgaagcaacgcgaagaaccttaccagggcttgacatccagtgcaaagctacagagatgtagtggaggctaacattgagacaggtggtgcatggttgtcgtcagctcgtgccgtgaggtgttgggttaagtcccgcaacgagcgcaacccctattattagttactaacattcagttgaggactctaatgagactgctagtgtaagctagaggaaggtggggatgacgtcaaatcatcatgccccttatgtcctgggctacacacgtgctacaatggttggtacaaagagtcgcaatcccgcgagggggagctaatctcaaaaagccaatctcagttcggattgaagtctgcaactcgacttcatgaagtcggaatcactagtaatcgcgaatcagcaacgtcgcggtgaatacgttctcgggtcttgtacacaccgcccgtcacaccatgagagttggtaataccagaagcacgtatcttaaccattaggagagagcgtaccaaggtaggactagcgattagggtgaagtcgtaacaaggtatccgtacgggaacgtgcggatggatcacctcctttcta

SEQ ID NO: 8731 - DNA, 1524 bp, Spiroplasma endosymbiont of Megaselia nigra
  ref <308>: DATABASE ACCESSION NUMBER: NCBI ACCESSION: NZ_RCOO01000044.1
  ref <309>: DATABASE ENTRY DATE: 2019-04-01
  ref <313>: RELEVANT RESIDUES IN SEQ ID NO: (1)..(1524)
tttttaatgagagtttgatcctggctcaggatgaacgctggcggcatgcctaatacatgcaagtcgaacggggtgcttgcacccagtggcgaacgggtgagtaacacgtatctaatctacccattagcgggggataacagttggaaacgactgctaataccgcatacgacattttctggcatcagagaatgttaaaaggtccgtttggatcactaatggatgaggatgcggcgtattagttagttggtggggtaatggcctaccaagacaatgatacgtagccgaactgagaggttgatcggccacatcgggactgagacacggcccgaactcctacgggaggcagcagtagggaatttttcacaatgggcgaaagcctgatggagcaatgccgcgtgactgaagacggtcttcggattgtaaaggtctgttgtaagggaagaacagtaagtataggaaatgatacttatttgactgtaccttaccagaaagccacggctaactatgtgccagcagccgcggtaatacataggtggcaagcgttatccggatttattgggcgtaaagcgtgcgcagacggtttaacaagtttggggtcaaatcctggagctcaactccagttcgccttgaaaactgttaagctagagtgtaggagaagtcgatggaattccatgtgtagcggtgaaatgcgtagatatatggaggaacaccagtggcgaaggcggtcgactggcctatcactgacgtttaggcacgaaagcgtagggagcaaataggattagataccctagtagtctacgccgtaaacgatgagtactaagtgtcggactaagttcggtgcttcagctaacgcattaagtactccgcctgagtagtatgctcgcaagagtgaaactcaaaggaattgacggggacccgcacaagcggtggagcatgtggtttaattcgaagcaacgcgaagaaccttaccaaggcttgacatccagtgcaaagctgtagaaatacagtggaggttaacattgagacaggtggtgcatggttgtcgtcagctcgtgccgtgaggtgtttggttaagtccagtaacgagcgcaacccttgccgttagttactccattaagttgagatactctaacgggactgctagtgtaagctagaggaaggtggggatgacgtcaaatcagcatgccccttatgtcttgggctacacacgtgctacaatggtcggtacaaacagttgcgttctcgtaagagggagctaatctgaaaaagccgatctcagttcggattgagggctgcaactcgccctcatgaagccggaatcgctagtaatcgcgaatcagcaatgtcgcggtgaatacgttctcgggtcttgtacacaccgcccgtcacaccatgagagttgataataccagaagtcggtattctaaccgcaaggaggaagccgcccaaggtaggattgatgattagggtgaagtcgtaacaaggtatccgtacgagaacgtgcggatggatcacctcctttct

SEQ ID NO: 8732 - DNA, 1522 bp, Spiroplasma melliferum
  ref <308>: DATABASE ACCESSION NUMBER: NCBI ACCESSION: NZ_PHSJ01000001.1
  ref <309>: DATABASE ENTRY DATE: 2019-04-01
  ref <313>: RELEVANT RESIDUES IN SEQ ID NO: (1)..(1522)
tttaatgagagtttgatcctggctcaggatgaacgctggcggcatgcctaatacatgcaagtcgaacggggtgcttgcacccagtggcgaacgggtgagtaacacgtatctaatctacccattagcgggggataacagttggaaacgactgctaataccgcatacgacattttctggcatcagagaatgttaaaaggtccgtttggatcactaatggatgaggatgcggcgtattagttagttggtggggtaatggcctaccaagacaatgatacgtagccgaactgagaggttgatcggccacatcgggactgagacacggcccgaactcctacgggaggcagcagtagggaatttttcacaatgggcgaaagcctgatggagcaatgccgcgtgactgaagacggtcttcggattgtaaaggtctgttgtaagggaagaacagtaagtataggaaatgatacttatttgacggtaccttaccagaaagccacggctaactatgtgccagcagccgcggtaatacataggtggcaagcgttatccggatttattgggcgtaaagcgtgcgcagacggtttaacaagtttggggtcaaatcctggagctcaactccagttcgccttgaaaactgttaagctagagtgtaggagaggtcgatggaattccatgtgtagcggtgaaatgcgtagatatatggaggaacaccagtggcgaaggcggtcgactggcctatcactgacgtttaggcacgaaagcgtagggagcaaataggattagataccctagtagtctacgccgtaaacgatgagtactaagtgtcggactaagttcggtgctgcagttaacgcattaagtactccgcctgagtagtatgctcgcaagagtgaaactcaaaggaattgacggggacccgcacaagcggtggagcatgtggtttaattcgaagcaacgcgaagaaccttaccaaggcttgacatccagtgcaaagctgtagaaatacagtggaggttaacattgagacaggtggtgcatggttgtcgtcagctcgtgccgtgaggtgtttggttaagtccagtaacgagcgcaacccttgccgttagttactccattaagttgagatactctaacgggactgctagtgtaagctagaggaaggtggggatgacgtcaaatcagcatgccccttatgtcttgggctacacacgtgctacaatggtcggtacaaacagttgcgatctcgtaagagggagctaatctgaaaaagccgatctcagttcggattgagggctgcaactcgccctcatgaagccggaatcgctagtaatcgcgaatcagcaatgtcgcggtgaatacgttctcgggtcttgtacacaccgcccgtcacaccatgagagttgataataccagaagtcggtattctaaccgcaaggaggaagccgcccaaggtaggattgatgattagggtgaagtcgtaacaaggtatccgtacgagaacgtgcggatggatcacctcctttct

SEQ ID NO: 8733 - DNA, 1522 bp, Spiroplasma poulsonii
  ref <308>: DATABASE ACCESSION NUMBER: NCBI ACCESSION: NZ_RAHC01000009.1
  ref <309>: DATABASE ENTRY DATE: 2019-04-01
  ref <313>: RELEVANT RESIDUES IN SEQ ID NO: (1)..(1522)
tttaatgagagtttgatcctggctcaggatgaacgctggcggcatgcctaatacatgcaagtcgaacggggtgcttgcacccagtggcgaacgggtgagtaacacgtatctaatctacccattagcgggggataacagttggaaacgactgctaataccgcatacgacattttctggcatcagagaatgttaaaaggtccgtttggaccactaatggatgagggtgcggcgtattagttagttggtggggtaatggcctaccaagacagtgatacgtagccgaactgagaggttgaacggccacatcgggactgagacacggcccgaactcctacgggaggcagcagtagggaatttttcacaatgggcgaaagcctgatggagcaatgccgcgtgactgaagacggtcttcggattgtaaaggtctgttgtaagggaagaacagtaagtataggaaatgatacttatttgacggtaccttaccagaaagccacggctaactatgtgccagcagccgcggtaatacataggtggcaagcgttatccggatttattgggcgtaaagcgtgcgcagacggtttaacaagtttggggtcaaatcctggagcttaactccagttcgccttgaaaactgttaagctagagtgtaggagaggtcgatggaattccatgtgtagcggtgaaatgcgtagatatatggaggaacaccagtggcgaaggcggtcgaccggcctatcactgacgtttaggcacgaaagcgtagggagcaaataggattagataccctagtagtctacgccgtaaacgatgagtactaagtgtcggactaagttcggtgctgcagctaacgcattaagtactccgcctgagtagtatgctcgcaagagtgaaactcaaaggaattgacggggacccgcacaagcggtggagcatgtggtttaattcgaagcaacgcgaagaaccttaccaaggcttgacatccagtgcaaagctgtagaaatacagtggaggttaacattgagacaggtggtgcatggttgtcgtcagctcgtgccgtgaggtgtttggttaagtccagtaacgagcgcaacccttgccgttagttactccattaagttgagatactctaacgggactgctagtgtaagctagaggaaggtggggatgacgtcaaatcatcatgccccttatgtcttgggctacacacgtgctacaatggccggtacaaacagttgcgatctcgcaagagggagctaatctgaaaaagccggtctcagttcggattgagggctgcaactcgccctcatgaagccggaatcgctagtaatcgcgaatcagcaatgtcgcggtgaatacgttctcgggtcttgtacacaccgcccgtcacaccatgagagttgataataccagaagtcggtattctaaccgcaaggaggaagccgcccaaggtaggattgatgattagggtgaagtcgtaacaaggtatccgtacgagaacgtgcggatggatcacctcctttct

SEQ ID NO: 8734 - DNA, 1510 bp, Spirosoma aerolatum
  ref <308>: DATABASE ACCESSION NUMBER: NCBI ACCESSION: NZ_CP020104.1
  ref <309>: DATABASE ENTRY DATE: 2019-04-01
  ref <313>: RELEVANT RESIDUES IN SEQ ID NO: (1)..(1510)
tttacgatggagagtttgatcctggctcaggatgaacgctagcggcaggcctaatacatgcaagtcgaacgggccgcaaggtcagtggcaaacgggtgcgtaacgcgtaagcaacctgcctcaaactgggggatagcccggcgaaagctggggtaaacccgcacggtcccagggagtcacctgactttttgggtaaacatttatgggtttgagaggggcttgcgtctgattagctagttggcggggtaacggctcaccaaggcgatgatcagtaggggttctgagaggattggcccccacatgggtactgagatacggacccaactcctacgggaggcagcagtagggaatattgggcaatggaggcaactctgacccagccatgccgcgtgcaggatgaaggcgctcagcgttgtaaactgcttttactcatgaagaacggccttcttgcgagagggtgtgacggtaatgagggaataagcaccggctaactccgtgccagcagccgcggtaatacggagggtgcaagcgttgtccggatttattgggtttaaagggtgcgtaggtggcagagtaagtctggtttgaaagctggtcgcttaacgatcagatgtggctggaaactgctttgcttgaatgggttggcggtagctggaacgggtcatgtagcggtgaaatgcatagatatgacccagaaccccgattgcgaaggcaggctactacgacttgattgacactgaggcacgagagcatggggagccaacaggattagataccctggtagtccatgccgtaaacgatgattactggctgtttgtccgaatggatgagtggctgagcgaaagcgttaagtaatccacctggggagtacgccggcaacggtgaaactcaaaggaattgacgggggtccgcacaagcggtggagcatgtggtttaattcgatgatacgcgaggaaccttacctgggctagaatgtgagagaagttatcagaaatggtagcgtgcagcaatgtactcaaaacaaggtgctgcatggctgtcgtcagctcgtgccgtgaggtgttgggttaagtcccgcaacgagcgcaacccctactgtcagttaccagcgcgtaatggcggggactctggcaggactgcctgcgcaagcagagaggaaggaggggacgacgtcaagtcatcatggcccttacgcccagggcgacacacgtgctacaatggtcggtacagcgggttgcgatacggtaacgtggagccaatcttgtaaagccggtcacagttcggattggggtctgcaacccgaccccatgaagctggaatcgctagtaatcgcgcatcagccatggcgcggtgaatacgttcccggaccttgtacacaccgcccgtcaagccatgggagttggggggacctgaagtgggaggtaaagatcccataagggtaaactcggcgactggggctaagtcgtaacaaggtagccgtaccggaaggtgcggctggaacacctccttt

SEQ ID NO: 8735 - DNA, 1520 bp, Spirosoma fluviale
  ref <308>: DATABASE ACCESSION NUMBER: NCBI ACCESSION: NZ_OCNH01000012.1
  ref <309>: DATABASE ENTRY DATE: 2019-04-01
  ref <313>: RELEVANT RESIDUES IN SEQ ID NO: (1)..(1520)
tttacgatggagagtttgatcctggctcaggatgaacgctagcggcaggcctaatacatgcaagtcgaacggtagattccttcgggattctatagtggcaaacgggtgcgtaacgcgtaagcaacctgcctcatactgggggatagcccggcgaaagctggggtaaacccgcacggttccaagagatcacctggttttttgggtaaacattcatgggtatgagaggggcttgcgtctgattagttagttggcagggtaacggcctaccaagacgatgatcagtaggggttctgagaggattggcccccacatgggtactgagatacggacccaactcctacgggaggcagcagtagggaatattgggcaatggaggcaactctgacccagccatgccgcgtgcaggatgaaggcgctcagcgttgtaaactgcttttattggtgaagaactgtagtcctgcgggattatttgacggtagccaaggaataagcaccggctaactccgtgccagcagccgcggtaatacggagggtgcaagcgttgtccggatttattgggtttaaagggtgcgtaggtggtcatttaagtctgatttgaaagcaggcggcttaaccgtctgatgtggttggaaactgaatgacttgaatgggttggcggtagccggaatgggtcatgtagcggtgaaatgcatagatatgacccggaacaccgattgcgaaggcaggctactacgacttgattgacactgaggcacgagagcatgggtagcgaacaggattagataccctggtagtccatgccgtaaacgatgattactggctgtgtgcgttctaacgtgcgtggctgagcgaaagcgttaagtaatccacctggggagtacgctggcaacagtgaaactcaaaggaattgacgggggtccgcacaagcggtggagcatgtggtttaattcgatgatacgcgaggaaccttacctgggctagaatgtgcgtgaagggttcagaaatgggtccgtgtagcaatacacacaaaacaaggtgctgcatggctgtcgtcagctcgtgccgtgaggtgttgggttaagtcccgcaacgagcgcaacccctgtacttagttgccagcgagtaatgtcgggaactctaagtagactgcctgcgcaagcagagaggaagggggggacgacgtcaagtcatcatggcccttacgtccagggcgacacacgtgctacaatggtcggtacagcgggtagcgagggggtaacccggagccaatcttgtaaagccggtcacagttcggattggggtctgcaacccgaccccatgaagctggaatcgctagtaatcgcgcatcagccatggcgcggtgaatacgttcccggaccttgtacacaccgcccgtcaagccatgggaattggggggacctgaaggtcggtttcaaagccgggcaagggtaaactcggtgactagggctaagtcgtaacaaggtagccgtaccggaaggtgcggctggaacacctccttt

SEQ ID NO: 8736 - DNA, 1512 bp, Spirosoma montaniterrae
  ref <308>: DATABASE ACCESSION NUMBER: NCBI ACCESSION: NZ_CP014263.1
  ref <309>: DATABASE ENTRY DATE: 2019-04-01
  ref <313>: RELEVANT RESIDUES IN SEQ ID NO: (1)..(1512)
tttacgatggagagtttgatcctggctcaggatgaacgctagcggcaggcctaatacatgcaagtcgaacgggtcgcaagaccagtggcaaacgggtgcgtaacgcgtaaacaacctgcccacaactgggggatagcccggcgaaagcgggggtaaacccgcatggttccgtttgatcacctgatgagacggataaacattaatgggttgtggaggggtttgcgtctgattaggtagttggtggggtaacggctcaccaagccgacgatcagtaggggttctgagaggattggcccccacatgggtactgagagacggacccaactcctacgggaggcagcagtagggaatattgggcaatgggcgcaagcctgacccagccatgccgcgtgaaggacgaaggcgctctgcgttgtaaacttcttttctcaacgaagaacggtgggcatgcgtgctcatgtgccggtagttgaggaataagcaccggctaactccgtgccagcagccgcggtaatacggagggtgcgagcgttgtccggatttattgggtttaaagggtgcgtaggtggtctgttaagtctggtttgaaagtcggcggctcaaccgtcggacgtggctggaaactgggggacttgaatgcgatagcggtagctggaatgggtcatgtagcggtgaaatgcatagatatgacccggaactccaattgcgaaggcaggctactgggtcgtgattgacactgaggcacgagagcaggggtagcaaacaggattagataccctggtagtccctgccgtaaacgatgatcactgactgtctgtccgcatggatgggtggttaagcgaaagcgttaagtgatccacctggggagtacgccggcaacggtgaaactcaaaggaattgacgggggtccgcacaagcggtggagcatgtggtttaattcgatgatacgcgaggaaccttacctgggctagaatgtgagagaagtactcagaaatgggtgcgtgcagcaatgtactcgaaacaaggtgctgcatggctgtcgtcagctcgtgccgtgaggtgttgggttaagtcccgcaacgagcgcaacccctatggtctgttgccagcacgtaatggtggggactcagatcagactgcctgcgcaagcagagaggaaggcggggacgacgtcaagtcatcatggcccttacgcccagggcgacacacgtgctacaatggtcggtacagcgggtagcgaggcagcaatgcggagccaatcttgtaaagccggtcacagttcggattggggtctgcaacccgaccccatgaagctggaatcgctagtaatcgcgcatcagccatggcgcggtgaatacgttcccggaccttgtacacaccgcccgtcaagccatgggagttggggggacctgaagttcggggttatagccggacaagggtaaatctggcgactggggctaagtcgtaacaaggtagccgtaccggaaggtgcggctggaacacctcctttct

SEQ ID NO: 8737 - DNA, 1510 bp, Spirosoma panaciterrae
  ref <308>: DATABASE ACCESSION NUMBER: NCBI ACCESSION: NZ_KB893238.1
  ref <309>: DATABASE ENTRY DATE: 2019-04-01
  ref <313>: RELEVANT RESIDUES IN SEQ ID NO: (1)..(1510)
tttacgatggagagtttgatcctggctcaggatgaacgctagcggcaggcctaatacatgcaagtcgaacgggccgcaaggtcagtggcaaacgggtgcgtaacgcgtaagcaacctgcctcaaactgggggatagcccggcgaaagctggggtaaacccgcacggtcccaaggagtcacctggttttttgggtaaacatttatgggtttgagaggggcttgcgtctgattagctagttggcggggtaacggctcaccaaggcgatgatcagtaggggttctgagaggattggcccccacatgggtactgagatacggacccaactcctacgggaggcagcagtagggaatattgggcaatggaggcaactctgacccagccatgccgcgtgcaggatgaaggcgctcagcgttgtaaactgcttttatctaggaagaacggctgatttgcgaatcagtgtgacggtactagaggaataagcaccggctaactccgtgccagcagccgcggtaatacggagggtgcaagcgttgtccggatttattgggtttaaagggtgcgtaggtggtcctgtaagtctggtttgaaagctggtggcttaaccatcagatgtggctggaaactgtgggacttgaatgggttggcggtagctggaacgggtcatgtagcggtgaaatgcatagatatgacccagaaccccgattgcgaaggcaggctactacgacttgattgacactgaggcacgagagcatggggagccaacaggattagataccctggtagtccatgccgtaaacgatgattactggctgtttgtgagatatcatgagtggctgagcgaaagcgttaagtaatccacctggggagtacgccggcaacggtgaaactcaaaggaattgacgggggtccgcacaagcggtggagcatgtggtttaattcgatgatacgcgaggaaccttacctgggctagaatgtgagagaagttatcagaaatggtagcgtgcagcaatgtactcaaaacaaggtgctgcatggctgtcgtcagctcgtgccgtgaggtgttgggttaagtcccgcaacgagcgcaacccctactgtcagttaccagcgcgtaatggcggggactctggcaggactgcctgcgcaagcagagaggaaggaggggacgacgtcaagtcatcatggcccttacgcccagggcgacacacgtgctacaatggtcggtacagcgggttgcgatacggtaacgtggagccaatcttgtaaagccggtcacagttcggattggggtctgcaacccgaccccatgaagctggaatcgctagtaatcgcgcatcagccatggcgcggtgaatacgttcccggaccttgtacacaccgcccgtcaagccatgggagttggggggacctgaagtgggaggtaaagatcccataagggtaaactcggcgactggggctaagtcgtaacaaggtagccgtaccggaaggtgcggctggaacacctccttt

SEQ ID NO: 8738 - DNA, 1517 bp, Spirosoma pollinicola
  ref <308>: DATABASE ACCESSION NUMBER: NCBI ACCESSION: NZ_CP025096.1
  ref <309>: DATABASE ENTRY DATE: 2019-04-01
  ref <313>: RELEVANT RESIDUES IN SEQ ID NO: (1)..(1517)
tttacgatggagagtttgatcctggctcaggatgaacgctagcggcaggcctaatacatgcaagtcgaacggttcgcaaggacagtggcaaacgggtgcgtaacgcgtaagcaacctgcctcatactgggggatagcccggcgaaagctggggtaaacccgcacggtcccgtgtgatcacctggtgatacgggtaaacatttatgggtatgagaggggcttgcgtctgattagttagttggcagggtaacggcctaccaagacgatgatcagtaggggttctgagaggattggcccccacatgggtactgagatacggacccaactcctacgggaggcagcagtagggaatattgggcaatggaggcaactctgacccagccatgccgcgtgcaggatgaaggcgctcagcgttgtaaactgcttttactggtgaagaaagcttgtcctgcgggatgatttgacggtagccagggaataagcaccggctaactccgtgccagcagccgcggtaatacggagggtgcaagcgttgtccggatttattgggtttaaagggtgcgtaggtggtcatttaagtctgatttgaaagcaggcggcttaaccgtctgatgtggttggaaactgaatgacttgaatgggttggcggtagccggaatgggtcatgtagcggtgaaatgcatagatatgacccggaacaccgattgcgaaggcaggctactacgacttgattgacactgaggcacgagagcatgggtagcgaacaggattagataccctggtagtccatgccgtaaacgatgattactggctgtgtgtgttctaacatgcgtggctgagcgaaagcgttaagtaatccacctggggagtacgctggcaacagtgaaactcaaaggaattgacgggggtccgcacaagcggtggagcatgtggtttaattcgatgatacgcgaggaaccttacctgggctagaatgtgcgtgaaggtatcagaaatggtgccgtgtagcaatacacacaaaacaaggtgctgcatggctgtcgtcagctcgtgccgtgaggtgttgggttaagtcccgcaacgagcgcaacccctgtacttagttgccagcgagtaatgtcgggaactctaagtagactgcctgcgcaagcagagaggaagggggggacgacgtcaagtcatcatggcccttacgcccagggcgacacacgtgctacaatggtcggtacagcgggtagcgatccggtaacggggagccaatcttgtaaagccggtcacagttcggattggggtctgcaacccgaccccatgaagctggaatcgctagtaatcgcgcatcagccatggcgcggtgaatacgttcccggaccttgtacacaccgcccgtcaagccatgggaattggggggacctgaaggtcggtataatagccgggcaagggtaaactcggtgactagggctaagtcgtaacaaggtagccgtaccggaaggtgcggctggaacacctcctttttggagc

SEQ ID NO: 8739 - DNA, 1508 bp, Spirosoma sp. HMF3257
  ref <308>: DATABASE ACCESSION NUMBER: NCBI ACCESSION: NZ_QLII01000001.1
  ref <309>: DATABASE ENTRY DATE: 2019-04-01
  ref <313>: RELEVANT RESIDUES IN SEQ ID NO: (1)..(1508)
tttacgatggagagtttgatcctggctcaggatgaacgctagcggcaggcctaatacatgcaagtcgaacggttcgcaaggacagtggcaaacgggtgcgtaacgcgtaagcaacctgcctcatactgggggatagcccggcgaaagctggggtaaacccgcacggtccagtgtcatcacctggtgatcttggtaaacatttatgggtatgagaggggcttgcgtctgattagctagttggggggtaacggcccaccaaggcgatgatcagtaggggttctgagaggattggcccccacatgggtactgagatacggacccaactcctacgggaggcagcagtagggaatattgggcaatggacggaagtctgacccagccatgccgcgtgcaggatgaaggcgctcagcgttgtaaactgcttttatcagggaagaacagcagtcctgcgggattgtgtgacggtacctgaggaataagcaccggctaactccgtgccagcagccgcggtaatacggagggtgcaagcgttgtccggatttattgggtttaaagggtgcgtaggtggtttaataagtctggtttgaaagcaagcggcttaaccgtttgatgtggctggaaactgttgaacttgaatgcgttggcggtagccggaacgggtcatgtagcggtgaaatgcatagatatgacccagaacaccgattgcgaaggcaggctactacgacgggattgacactgaggcacgagagcatgggtagcgaacaggattagataccctggtagtccatgccgtaaacgatgattactggctgtgtgtgttcaaacatgcgtggctgagcgaaagcgttaagtaatccacctggggagtacgctggcaacagtgaaactcaaaggaattgacgggggtccgcacaagcggtggagcatgtggtttaattcgatgatacgcgaggaaccttacctgggctagaatgtgcgtgaagggctcagaaatgggtccgtgtagcaatacacacaaaacaaggtgctgcatggctgtcgtcagctcgtgccgtgaggtgttgggttaagtcccgcaacgagcgcaacccctgtacttagttgccagcgagtaatgtcgggaactctaagtagactgcctgcgcaagcagagaggaaggggggacgacgtcaagtcatcatggcccttacgtccagggcgacacacgtgctacaatggtcggtacagcgggtagcgatagggtaacctggagccaatcttgtaaagccggtcacagttcggattggggtctgcaacccgaccccatgaagctggaatcgctagtaatcgcgcatcagccatggcgcggtgaatacgttcccggaccttgtacacaccgcccgtcaagccatggaagttggggggacctgaagtgggaggtaaaagtcttatcagggtaaactcggtaactagggctaagtcgtaacaaggtagccgtaccggaaggtgcggctggaacacctccttt

SEQ ID NO: 8740 - DNA, 1512 bp, Spirosoma sp. TY50
  ref <308>: DATABASE ACCESSION NUMBER: NCBI ACCESSION: NZ_SBLB01000023.1
  ref <309>: DATABASE ENTRY DATE: 2019-04-01
  ref <313>: RELEVANT RESIDUES IN SEQ ID NO: (1)..(1512)
tttacgatggagagtttgatcctggctcaggatgaacgctagcggcaggcctaatacatgcaagtcgagcgggtcgcaagaccagcggcaaacgggtgcgtaacgcgtaagcaacctgccctcaactgggggatagccctgcgaaagcgggggtaaacccgcatagtcccctggagtcacctggctttttgggtaaacatttatgggttgaggaggggcttgcgtctgattagctagttgggggggtaacggcccaccaaggcgatgatcagtaggggttctgagaggattggcccccacacgggtactgagagacggacccgactcctacgggaggcagcagtagggaatattgggcaatggaggcaactctgacccagccatgccgcgtgcaggatgaaggcgctcagcgttgtaaactgcttttatcagggaagaactgtagtcctgcgggattatttgacggtacctgaggaataagcaccggctaactccgtgccagcagccgcggtaatacggagggtgcaagcgttgtccggatttattgggtttaaagggtgcgtaggtggggtctcaagtctggtttgaaagtcggcggcttaaccgttggatgtggctggaaactgggattcttgaatgcgctggcggtagccggaacgggtcatgtagcggtgaaatgcatagatatgacccagaacaccgattgcgaaggcaggctactacggcgtgattgacactgaggcacgagagcatgggtagcgaacaggattagataccctggtagtccatgccgtaaacgatgattactggctgtttgccctttggggtgagtggctgagcgaaagcgttaagtaatccacctggggagtacgccggcaacggtgaaactcaaaggaattgacgggggtccgcacaagcggtggagcatgtggtttaattcgatgatacgcgaggaaccttacctgggctagaatgcgcgtgaaggtatcagaaatggtaccgtgtagtgatacacacaaagcaaggtgctgcatggctgtcgtcagctcgtgccgtgaggtgttgggttaagtcccgcaacgagcgcaacccctatgatttgttgccagcgggtaatgccggggactcaagtcagactgcctgcgcaagcagagaggaagggggggacgacgtcaagtcatcatggcccttacgtccagggcgacacacgtgctacaatggtcggtacagcgggtcgcgatcccgcaagggggagccaatcttgtaaagccggtcacagttcggattggggtctgcaacccgaccccatgaagctggaatcgctagtaatcgcgcatcagccatggcgcggtgaatacgttcccggaccttgtacacaccgcccgtcaagccatgggagttggggggacctgaagttcggggttacaaccggacaagggtaaactcggcgactggggctaagtcgtaacaaggtagccgtaccggaaggtgcggctggaacacctcctttct

SEQ ID NO: 8741 - DNA, 1494 bp, Spirulina major
  ref <308>: DATABASE ACCESSION NUMBER: NCBI ACCESSION: NZ_KV878783.1
  ref <309>: DATABASE ENTRY DATE: 2019-04-01
  ref <313>: RELEVANT RESIDUES IN SEQ ID NO: (1)..(1494)
aaaatggagagtttgatcctggctcaggatgaacgctggcggtatgcctaacacatgcaagtcgaacggtctcttcggagatagtggcggacgggtgagtaacacgtgagaatctggcttcaggatggggacaacagttggaaacgactgctaatacccgatatgccgaaaggtgaaagatttatcgcctgaagatgagctcgcggctgattagctagttggtggggtaagagcctaccaaggcgacgatcagtagctgttctgagaggaagatcagccacactgggactgagacacggcccagactcctacgggaggcagcagtggggaattttccgcaatgggcgaaagcctgacggagcaataccgcgtgcgggaggaaggcccttgggtcgtaaaccgcttttcttagggaagaaacctgacggtacctaaggaataagcctcggctaactccgtgccagcagccgcggtaatacggaggaggcaagcgttatccggaattattgggcgtaaagagtccgtaggtggttcatcaagtctgctgttaaagcgtgcagctcaactgcatataggcagtggaaactgttgaactagagtatggtaggggtagggggaattcccagtgtagcggtgaaatgcgtagagattgggaagaacaccggtggcgaaagcgccctactgggccataactgacactgagggacgaaagctagggtagcgaatgggattagataccccagtagtcctagccgtaaacgatggaaactaggcgtagcttgtatcgacccgagctgtgccgaagctaacgcgttaagtttcccgcctggggagtacgcacgcaagtgtgaaactcaaaggaattgacgggggcccgcacaagcggtggagtatgtggtttaattcgatgcaacgcgaagaaccttaccaaggcttgacatcccgcgaatctcttggaaacaggagagtgccttcgggaacgcggagacaggtggtgcatggctgtcgtcagctcgtgtcgtgagatgttgggttaagtcccgcaacgagcgcaacccttgtccttagttgccatcattaagttgggcactctagggagactgccggtgacaaaccggaggaaggtgaggatgacgtcaagtcagcatgccccttacgtcttgggctacacacgtactacaatggttgggacaaagggcagcaagctcgcgagagtaagcgaatctcaccaaacccagcctcagttcagattgcaggctgcaactcgcctgcatgaaggaggaatcgctagtaatcgcaggtcagcatactgcggtgaatccgttcccggggccttgtacacaccgcccgtcacaccatggaagctggcaacatccgaagtcgttactccaactgtttacagaggagggcgccgaaggtggggctagtgactggggtgaagtcgtaacaaggtagccgtaccggaaggtgtggctggatcacctcctttaaggg

SEQ ID NO: 8742 - DNA, 1491 bp, Spirulina subsalsa
  ref <308>: DATABASE ACCESSION NUMBER: NCBI ACCESSION: NZ_JH980292.1
  ref <309>: DATABASE ENTRY DATE: 2019-04-01
  ref <313>: RELEVANT RESIDUES IN SEQ ID NO: (1)..(1491)
aaaatggagagtttgatcctggctcaggatgaacgctggcggtatgcttaacacatgcaagtcgaacggactcttcggagttagtggcggacgggtgagtaacgcgtgagaatctgcctctaggtcggggacaacagttggaaacgactgctaatcccggatgagcctgcgggtaaaagattaattgcctagagaggagctcgcgtctgattagctagttggtgaggtaaaagctcaccaaggcgacgatcagtagctgttctgagaggaagaacagccacactgggactgagacacggcccagactcctacgggaggcagcagtggggaattttccgcaatgggcgaaagcctgacggagcaataccgcgtgagggaagaaggcctttgggtcgtaaacctcttttctcagggaagaagttctgacggtacctgaggaaaaagcctcggctaactccgtgccagcagccgcggtaatacggaggaggcaagcgttatccggaattattgggcgtaaagcgtccgtaggtggcctttcaagtctgcggttaaaaactagagctcaactctgggtcagccgtggaaactgagaagctagagtacagtaggggtagagggaattcccagtgtagcggtgaaatgcgtagagattgggaagaacaccggtggcgaaagcgctctactgggcttgtactgacactgagggacgaaagctaggggagcaaaagggattagatacccctgtagtcctagccgtaaacgatggaaactaggcgtagcctgtatcaactcaggctgtgccgaagctaacgcgttaagtttcccgcctggggagtacgcacgcaagtgtgaaactcaaaggaattgacgggggcccgcacaagcggtggagtatgtggtttaattcgatgcaacgcgaagaaccttaccagggcttgacatcccgcgaatcctgctgaaaggtaggagtgcctaagggaacgcggagacaggtggtgcatggctgtcgtcagctcgtgtcgtgagatgttgggttaagtcccgcaacgagcgcaaccctcgtccttagttgccatcattaagttgggaactctagggagactgccggggacaactcggaggaaggtggggatgacgtcaagtcagcatgccccttacgtcctgggctacacacgtactacaatggttgagacaaagggcagcgaactcgcgagagccagcgaatcccagcaaactcagccccagttcagattgcaggctgcaactcgcctgcatgaagtaggaatcgctagtaatcgccggtcagcatacggcggtgaatccgttcccgggccttgtacacaccgcccgtcacaccatggaagctggcaacatccgaagtcgttactccaaccgttagcggaggagggcgccgaaggtggggctagtgactggggtgaagtcgtaacaaggtagccgtaccggaaggtgtggctggatcacctcctttaa

SEQ ID NO: 8743 - DNA, 1262 bp, Sporanaerobacter acetigenes
  ref <308>: DATABASE ACCESSION NUMBER: NCBI ACCESSION: NZ_FQXR01000034.1
  ref <309>: DATABASE ENTRY DATE: 2019-04-01
  ref <313>: RELEVANT RESIDUES IN SEQ ID NO: (1)..(1262)
atcgcatgattttcaagtcaaagcgattaagcggtataagatggactcgcgtcccattagctagttggtgaggtaatagctcaccaaggcgacgatgggtagccggcctgagagggtgaacggccacactggaactgagacacggtccagactcctacgggaggcagcagtggggaatattgcacaatggagggaactctgatgcagcgacgccgcgtgagcgatgaaggttttcggatcgtaaagctctgtcctaagggacgataatgacggtaccttaggaggaagccccggctaactacgtgccagcagccgcggtaatacgtagggggcgagcgttgtccggatttattgggcgtaaagggtgcgtaggcggccttgtaagtcagatgtgaaatctcacggcttaaccgtggtaagcatttgaaactgtgaggcttgagtacaggagaggagagtggaattcctagtgtagcggtgaaatgcgtagatattaggaggaataccagtggcgaaggcgactctctggactgtaactgacgctgaggcacgaaagcgtggggagcaaacaggattagataccctggtagtccacgccgtaaacgatgagtgctaggtgtcgggggtcaaacctcggtgccgcagttaacacattaagcactccgcctggggagtacggtggcaacactgaaactcaaaggaattgacggggacccgcacaagcagcggagcatgtggtttaattcgatgcaacgcgaagaaccttaccagggcttgacatcccccggacggaactagagatagttcattcccttcggggactggggagacaggtggtgcatggttgtcgtcagctcgtgtcgtgagatgttgggttaagtcccgcaacgagcgcaacccttgtctttagttgcaaacagtcaggctgtgcactctaaagagactgccgatgacaaatcggaggaaggtggggatgacgtcaaatcatcatgccctttatgtcctgggctacacacgtgctacaatggtcggtacaacgggcagccacttagtgataaggagctaatcccacaaaaccgatcccagttcggattgtaggctgcaacccgcctacatgaagccggagttgctagtaatcgcggatcagaatgccgcggtgaatgcgttcccgggtcttgtacacaccgcccgtcacaccatgggagttgacaatacccgaagtcggtgagctaaccgtaaggaggcagccgccgaaggtaggg

SEQ ID NO: 8744 - DNA, 1534 bp, Sporanaerobacter sp. NJN-17
  ref <308>: DATABASE ACCESSION NUMBER: NCBI ACCESSION: NZ_CP035282.1
  ref <309>: DATABASE ENTRY DATE: 2019-04-01
  ref <313>: RELEVANT RESIDUES IN SEQ ID NO: (1)..(1534)
tttaaattgagagtttgatcctggctcaggacgaacgctggcggcgtgcttaacacatgcaagtcgagcgagggaatacttaggaagccttcgggaagaatacgtattccttagcggcggacgggtgagtaacgcgtgaggaatctgcctcgcacaaggggatagcctcgggaaaccgggattaataccctatgatacttacactgcgcatgcagagtaagttaaagaatatcggtgtgagatgacctcgcgtcccattagctggttggcagggtaaaagcctaccaaggcgacgatgggtagccggcctgagagggtgaacggccacattggaactgagacacggtccagactcctacgggaggcagcagtggggaatattgcacaatggagggaactctgatgcagcaacgccgcgtgagcgaagaaggttttaggatcgtaaagctctgtcctaggggaagataatgacggtacccgaggaggaagccccggctaactacgtgccagcagccgcggtaatacgtagggggcgagcgttgtccggaattattgggcgtaaagggtgcgtaggcggctgaacaagtcagatgtgaaaggttaaggcttaactttaataagcatatgaaactgttcagcttgagttaaggagaggggagtggaattcctagtgtagcggtgaaatgcgtagatattaggaggaataccagtggcgaaggcgactctctggacttaaactgacgctgaggcacgaaagcgtggggagcaaacaggattagataccctggtagtccacgccgtaaacgatgagtgctaggtgttgggtgtcaaagctcagtgccgcagctaacgcaataagcactccgcctggggagtacgatggcaacattgaaactcaaaggaattgacggggacccgcacaagcagcggagcatgtggtttaattcgatgcaacgcgaagaaccttaccaaggcttgacatccctctgaagtatatagagatatatacggcttttaggagacagaggagacaggtggtgcatggttgtcgtcagctcgtgtcgtgagatgttgggttaagtcccgcaacgagcgcaacccttacttttagttactaacaggtaaagctgaggactctaaaaggactgccggtgataaatcggaggaaggtggggatgacgtcaaatcatcatgccctttatgtcttgggctacacacgtgctacaatggtcggtacagagggaagcgacgccgcaaggtgaagcaaatcccaaaaagccgatcccagttcggattgcaggctgcaacccgcctgcatgaagctggagttgctagtaatcgcagatcagcatgctgcggtgaatgcgttcccgggtcttgtacacaccgcccgtcacaccatgggagttgacaatacccgaagccggtaagcgaacccgaaaggggagcagccgtcgaaggtagggttaatgactggggtgaagtcgtaacaaggtagccgtatcggaaggtgcggctggatcacctcctttct

SEQ ID NO: 8745 - DNA, 1461 bp, Sporanaerobacter sp. PP17-6a
  ref <308>: DATABASE ACCESSION NUMBER: NCBI ACCESSION: NZ_FMIF01000051.1
  ref <309>: DATABASE ENTRY DATE: 2019-04-01
  ref <313>: RELEVANT RESIDUES IN SEQ ID NO: (1)..(1461)
tttaaattgagagtttgatcctggctcaggacgaacgctggcggcgtgcttaacacatgcaagtcgagcgaaggaatacttaggaagccttcgggaagaatacgtattccttagcggcggacgggtgagtaacgcgtgaggaatctgcctcgcacaaggggatagcctcgggaaaccgggattaataccctatgatacttacactgcgcatgcagagtaagttaaagaatatcggtgtgagatgacctcgcgtcccattagctggttggcagggtaaaagcctaccaaggcgacgatgggtagccggcctgagagggtgaacggccacattggaactgagacacggtccagactcctacgggaggcagcagtggggaatattgcacaatggagggaactctgatgcagcaacgccgcgtgagcgaagaaggttttaggatcgtaaagctctgtcctaggggaagataatgacggtacccgaggaggaagccccggctaactacgtgccagcagccgcggtaatacgtagggggcgagcgttgtccggaattattgggcgtaaagggtgcgtaggcggctgaacaagtcagatgtgaaaggttaaggcttaactttaataagcatatgaaactgttcagcttgagttaaggagaggggagtggaattcctagtgtagcggtgaaatgcgtagatattaggaggaataccagtggcgaaggcgactctctggacttaaactgacgctgaggcacgaaagcgtggggagcaaacaggattagataccctggtagtccacgccgtaaacgatgagtgctaggtgttgggtgtcaaagctcagtgccgcagctaacgcaataagcactccgcctggggagtacgatggcaacattgaaactcaaaggaattgacggggacccgcacaagcagcggagcatgtggtttaattcgatgcaacgcgaagaaccttaccaaggcttgacatccctctgaagtatatagagatatatacggcttttaggagacagaggagacaggtggtgcatggttgtcgtcagctcgtgtcgtgagatgttgggttaagtcccgcaacgagcgcaacccttacttttagttactaacaggtaaagctgaggactctaaaaggactgccggtgataaatcggaggaaggtggggatgacgtcaaatcatcatgccctttatgtcttgggctacacacgtgctacaatggtcggtacagagggaagcgacaccgtaaggcgaagcaaatcccaaaaagccgatcccagttcggattgcaggctgcaacccgcctgcatgaagctggagttgctagtaatcgcagatcagcatgctgcggtgaatgcgttcccgggtcttgtacacaccgcccgtcacaccatgggagttgacaatacccgaagccggtaagcgaacccgaaaggggagcagccgtcgaagg

SEQ ID NO: 8746 - DNA, 1426 bp, Sporobacter termitidis
  ref <308>: DATABASE ACCESSION NUMBER: NCBI ACCESSION: NZ_FQXV01000034.1
  ref <309>: DATABASE ENTRY DATE: 2019-04-01
  ref <313>: RELEVANT RESIDUES IN SEQ ID NO: (1)..(1426)
ttattgagagtttgatcctggctcaggacgaacgctggcggcgtgcctaacacatgcaagtcgaacggagacaattggttcgctgattgtcttagtggcggacgggtgagtaacgcgtgagcaatctgcccttcggagggggacaacagctggaaacggctgctaataccgcataatgtatattcaaggcatcttggatataccaaagatttatcgccgaaggatgagctcgcgtctgattagctagttggtgaggtaaaggctcaccaaggctgcgatcagtagccggactgagaggttgaacggccacattgggactgagatacggcccagactcctacgggaggcagcagtggggaatattgggcaatgggggcaaccctgacccagcaacgccgcgtgaaggaagaaggccttcgggttgtaaacttctttgaccagggacgaaacaaatgacggtacctggaaaacaagccacggctaactacgtgccagcagccgcggtaatacgtaggtggcaagcgttgtccggatttactgggtgtaaagggcgcgtaggcgggagtacaagtcagatgtgaaatctgggggcttaaccctcaaactgcatttgaaactgtatttcttgagtatcggagaggcaggcggaattcctagtgtagcggtgaaatgcgtagatattaggaggaacaccagtggcgaaggcggcctgctggacgacaactgacgctgaggcgcgaaagcgtggggagcaaacaggattagataccctggtagtccacgctgtaaacgatgaatactaggtgtggggggactgaccccctccgtgccggagttaacacaataagtattccacctggggagtacggccgcaaggttgaaactcaaaggaattgacgggggcccgcacaagcagtggattatgtggtttaattcgaagcaacgcgaagaaccttaccagggcttgacatcgtactaacgaagcagagatgcattaggtgcccttcggggaaagtatagacaggtggtgcatggttgtcgtcagctcgtgtcgtgagatgttgggttaagtcccgcaacgagcgcaacccctattgttagttgctacgcgagagcactctagcgagactgccgttgacaaaacggaggaaggtggggacgacgtcaaatcatcatgccccttatgtcctgggctacacacgtaatacaatggcgctcaacagagggaagcaagaccgcgaggtggagcaaatccctaaaaggcgtctcagttcagattgcaggctgcaactcgcctgcatgaagtcggaattgctagtaatcgcggatcagcatgccgcggtgaatacgttcccgggccttgtacacaccgcccgtcacaccatgagagccgggaacacccgaagtccgtagtctaaccgcaagg

SEQ ID NO: 8747 - DNA, 1528 bp, Sporocytophaga myxococcoides
  ref <308>: DATABASE ACCESSION NUMBER: NCBI ACCESSION: NZ_BBLT01000026.1
  ref <309>: DATABASE ENTRY DATE: 2019-04-01
  ref <313>: RELEVANT RESIDUES IN SEQ ID NO: (1)..(1528)
tttacaatggagagtttgatcctggctcaggatgaacgctagcggcaggcctaatacatgcaagtcgaacggcagcgggtccagcaatggatgccggcgagtggcgcacgggtgcgtaacacgtatgcaatctacctgtaacttagggatagcccggagaaattcggattaatacctaatgataaccgagactggcatcagtttttgtttaaagatttatcggttacagatgagcatgcgtctgattagttagttggtgaggtaacggctcaccaagacgatgatcagtaggggacctgagagggtgatcccccacactggtactgagatacggaccagactcctacgggaggcagcagtagggaatattgggcaatggtcgagagactgacccagccatgccgcgtgcaggatgaaggccttatgggttgtaaactgcttttgatcgggaacaaagaggccatgcgtggcaagatgagtgtaccgatagaataagcaccggctaactccgtgccagcagccgcggtaatacggagggtgcaagcgttgtccggatttattgggtttaaagggtgcgtaggcggctgactaagtcagtggtgaaaggcagcagctcaactgttagcattgccattgatactggtcagcttgagtgcagtcgaggtaggcggaattgaaggtgtagcggtgaaatgcatagatatcttcaagaacacctattgcgaaggcagcttactaggctgtaactgacgctgatgcacgaaagcgtggggatcgaacaggattagataccctggtagtccacgctgtaaacgatgatcactcgctgttggcgatatacagtcagcggctaagcgaaagcaataagtgatccacctggggagtacgctcgcaagagtgaaactcaaaggaattgacgggggtccgcacaagcggtggagcatgtggtttaattcgatgatacgcgaggaaccttacctggactagaatgttagggaatgatgcagagatgtgtcagctagcaatagcccaaaacaaggtgctgcatggccgtcgtcagctcgtgccgtgaggtgttgggttaagtcccgcaacgagcgcaacccctatctttagttgccaacacgtaatggtggggactctagagagactgcctgcgtaagcagagaggaaggaggggatgacgtcaggtcatcatggcccttacgtccagggctacacacgtgctacaatggcgcatacagagtgttgcgagctggtaacagtaagccaatcacaaaaagtgcgtctcagttcggattgaggtctgcaactcgacctcatgaagctggaatcgctagtaatcgcgtatcagcaatgacgcggtgaatacgttcccggaccttgtacacaccgcccgtcaagccatgggagttggggagacctgaagacggtaaccgttgaggagccgtttagggtaaaaccagcgactggggctaagtcgtaacaaggtagccgtaccggaaggtgtggctggaacacctccttt

SEQ ID NO: 8748 - DNA, 643 bp, Sporolactobacillus inulinus
  ref <308>: DATABASE ACCESSION NUMBER: NCBI ACCESSION: NZ_AFVQ02000226.1
  ref <309>: DATABASE ENTRY DATE: 2019-04-01
  ref <313>: RELEVANT RESIDUES IN SEQ ID NO: (1)..(643)
tgaaagatggtttcggccatcacttacagatgggcccgcggtgcattagttagttggcggggtaatggcccaccaagaccgcgatgcatagccgacctgagagggtgatcggccacattgggactgagacacggcccaaactcctacgggaggcagcagtagggaatcttccacaatggacgaaagtctgatggagcaacgccgcgtgagcgaagaaggttttcggatcgtaaagctctgttgccggagaagaacgagtgccagaggaaatgctggtgctgtgacggtatccggccagaaagccacggctaactacgtgccagcagccgcggtaatacgtaggtggcaagcgttgtccggaattattgggcgtaaagcgcgcgcaggcggcttcttaagtctgatgtgaaatcttgcggctcaaccgcaaaaggtcattggaaactggggagcttgagtgcagaagaggagagtagaattccacgtgtagcggtgaaatgcgtagagatgtggaggaataccagtggcgaaggcggctctctggtctgttactgacgctgaggtgcgaaagcatggggagcaaacaggattagataccctggtagtccatgccgtaaacgatgaatgctaggtgttagggggg

SEQ ID NO: 8749 - DNA, 1560 bp, Sporolactobacillus laevolacticus
  ref <308>: DATABASE ACCESSION NUMBER: NCBI ACCESSION: NZ_AWTC01000005.1
  ref <309>: DATABASE ENTRY DATE: 2019-04-01
  ref <313>: RELEVANT RESIDUES IN SEQ ID NO: (1)..(1560)
ctttttggagagtttgatcctggctcaggacgaacgctggcggcgtgcctaatacatgcaagtcgagcgcatagaagggagcttgctccctgaagtgagcggcggatgggtgagtaacacgtgggtaacctgcctgtcagatcgggataactgtgggaaaccgcagctaataccggataatccttcgcaccgcatggtgcggagttgaaagatggtttcggccatcactgacagatgggcccgcggtgcattagttagttggcggggtaacggcccaccaagacagcgatgcatagccgacctgagagggtgatcggccacattgggactgagacacggcccaaactcctacgggaggcagcagtagggaatcttccacaatggacgaaagtctgatggagcaacgccgcgtgagcgaagaaggttttcggatcgtaaagctctgttgctggagaagaacgagtgcgagaggaaatgctcgtactgtgacggtatccagccagaaagccacggctaactacgtgccagcagccgcggtaatacgtaggtggcaagcgttgtccggaattattgggcgtaaagcgcgcgcaggcggcttcttaagtctgatgtgaaatcttgcggctcaaccgcaaacggtcattggaaactgggaagcttgagtgcagaagaggagagtagaattccacgtgtagcggtgaaatgcgtagatatgtggaggaataccagtggcgaaggcggctctctggtctgtaactgacgctgaggcgcgaaagcgtggggagcaaacaggattagataccctggtagtccacgccgtaaacgatgaatgctaggtgttaggggggtccaaccccttagtgctgaagttaacacattaagcattccgcctggggagtacgaccgcaaggttgaaactcaaaggaattgacgggggcccgcacaagcagtggagcatgtggtttaattcgaagcaacgcgaagaaccttaccaggtcttgacatcctctgacaagcctagagataggccgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgatctgggctacacacgtgctacaatgggtggtacaaagggcagcgaaaccgcgaggtcgagctaatcccataaagccacccccagttcggattgcaggctgcaactcgcctgcatgaagccggaattgctagtaatcgcggatcagcatgccgcggtgaatccgttcccgggccttgtacacaccgcccgtcacaccacgagagtttgtaacacccgaagtcggtgcgagaacctttatggactcagccgccgaaggtgggacaaatgattggggtgaagtcgtaacaaggtagccgtatcggaaggtgcggctggatcacctcctttctaaggaa

SEQ ID NO: 8750 - DNA, 396 bp, Sporomusa malonica
  ref <308>: DATABASE ACCESSION NUMBER: NCBI ACCESSION: NZ_FWXI01000023.1
  ref <309>: DATABASE ENTRY DATE: 2019-04-01
  ref <313>: RELEVANT RESIDUES IN SEQ ID NO: (1)..(396)
ttttattggagagtttgatcctggctcaggacgaacgctggcggcgtgcctaacacatgcaagtcgaacggagtaagtagcaatacttacttagtggcgaacgggtgagtaacgcgtagataacctgcctctaaaatggggacaacaccgcgaaagtggtgctaataccgaatgtggtatctcggttgcatgaccgagataagaaagatggcctctatatataagctatcgtttagagatgggtctgcgtctgattagctagttggtgaggtaatagctcaccaaggcgacgatcagtagccggtctgagaggatgaacggccacactgggactgagacacggcccagactcctacgggaggcagcagtggggaatcttccgcaatggacgaaagt

SEQ ID NO: 8751 - DNA, 1801 bp, Sporomusa ovata
  ref <308>: DATABASE ACCESSION NUMBER: NCBI ACCESSION: NZ_ASXP01000004.1
  ref <309>: DATABASE ENTRY DATE: 2019-04-01
  ref <313>: RELEVANT RESIDUES IN SEQ ID NO: (1)..(1801)
ttatggagagtttgatcctggctcaggacgaacgctggcggcgtgcctaacacatgcaagtcgaacggattctcgaggtgcgggaatcgaggtgcgaagatcgaagggcaacctaattgaccatcgcatttcgcctctcgcacttcgaaatcagtggcgaacgggtgagtaacgcgtagacaacctgcctctaaactggggacaacaccgcgaaagtggtgctaataccgaatgtggtatcttggtcgcatgactgagataagaaaggtggcctctgttcgaggtgcgagaatcgaggtgcgaagatcgaaaaggaaacttatcgaccctcgcatttcgcctctcgcccttcgagacatgctaccgcttagagatgggtctgcgtctgattagctagttggtgaggtaacggctcaccaaggcaacgatcagtagccggtctgagaggatgaacggccacactgggactgagacacggcccagactcctacgggaggcagcagtggggaatcttccgcaatggacgaaagtctgacggagcaacgccgcgtgagtgaagaaggtcttcggattgtaaagctctgtcgtttgggacgaacgtattctatgtgaataatgtagagtaatgacggtaccaaaggaggaagccacggctaactacgtgccagcagccgcggtaatacgtaggtggcaagcgttgtccggaattattgggcgtaaagggcgtgtaggtggatgtttaagtcgtgtgtctaagtgcggggctcaaccccgtataggcgcaggaaactggagatcttgagtgcaggagaggaaagtggaattcccagtgtagcggtgaaatgcgtagatattgggaggaacaccagtggcgaaggcgactttctggactgtgtctgacactgaggcgcgaaagccaggggagcgaacgggattagataccccggtagtcctggccgtaaacgatgggtactaggtgtagagggtatcgaccccttctgtgccgcaagcaaacgcaataagtaccccgcctggggagtacggccgcaaggttgaaactcaaaggaattgacgggggcccgcacaagcggtggagtatgtggtttaattcgacgcaacgcgaagaaccttaccaggacttgacattgagtgaaaagctaagagattagttcctatccttcgggatacacgaaaacaggtggtgcatggctgtcgtcagctcgtgtcgtgagatgttgggttaagtcccgcaacgagcgcaacccttatcctttgttgccagcacgtaatggtgggaactcaagggagactgccgcagacaatgcggaggaaggcggggatgacgtcaagtcatcatgccccttatgtcctgggctacacacgtactacaatgggcttaaacaaagcgaagcaagcccgcgagggtaagccaaacgcataaacaagctctcagttcggatcggaggctgcaactcgcctccgtgaagtcggaatcgctagtaatcgcaggtcagcatactgcggtgaatacgttcccgggccttgtacacaccgcccgtcacaccacgaaagttgacaacacccgaagccggtggggtaaccgattcgacattggattttcgacatacgacaatcgaaaggaaagacgaaagtcttgcaagaacccaatcgaaagtcaaaggtcgaaggtcgaatgtcgaaccggggctagccgtctaaggtggggccgatgattggggtgaagtcgtaacaaggtagccgtatcggaaggtgcggctggatcacctcctttctagggaga

SEQ ID NO: 8752 - DNA, 1801 bp, Sporomusa sp. An4
  misc_feature (1726)..(1726): n is a, c, g, or t
  ref <308>: DATABASE ACCESSION NUMBER: NCBI ACCESSION: NZ_CTRP01000014.1
  ref <309>: DATABASE ENTRY DATE: 2019-04-01
  ref <313>: RELEVANT RESIDUES IN SEQ ID NO: (1)..(1801)
ttatggagagtttgatcctggctcaggacgaacgctggcggcgtgcctaacacatgcaagtcgaacggattctcgaggtgcgggaatcgaggtgcgaagatcgaagggcaacctaattgaccatcgcatttcgcctctcgcacttcgaaatcagtggcgaacgggtgagtaacgcgtagacaacctgcctctaaactggggacaacaccgcgaaagtggtgctaataccgaatgtggtatcttggtcgcatgactgagataagaaaggtggcctctgttcgaggtgcgagaatcgaggtgcgaagatcgaaaaggaaacttatcgaccctcgcatttcgcctctcgcccttcgagacatgctaccgcttagagatgggtctgcgtctgattagctagttggtgaggtaacggctcaccaaggcaacgatcagtagccggtctgagaggatgaacggccacactgggactgagacacggcccagactcctacgggaggcagcagtggggaatcttccgcaatggacgaaagtctgacggagcaacgccgcgtgagtgaagaaggtcttcggattgtaaagctctgtcgtttgggacgaacgtattctatgtgaataatgtagagtaatgacggtaccaaaggaggaagccacggctaactacgtgccagcagccgcggtaatacgtaggtggcaagcgttgtccggaattattgggcgtaaagggcgtgtaggtggatgtttaagtcgtgtgtctaagtgcggggctcaaccccgtataggcgcaggaaactggagatcttgagtgcaggagaggaaagtggaattcccagtgtagcggtgaaatgcgtagatattgggaggaacaccagtggcgaaggcgactttctggactgtgtctgacactgaggcgcgaaagccaggggagcgaacgggattagataccccggtagtcctggccgtaaacgatgggtactaggtgtagagggtatcgaccccttctgtgccgcaagcaaacgcaataagtaccccgcctggggagtacggccgcaaggttgaaactcaaaggaattgacgggggcccgcacaagcggtggagtatgtggtttaattcgacgcaacgcgaagaaccttaccaggacttgacattgagtgaaaagctaagagattagttcctatccttcgggatacacgaaaacaggtggtgcatggctgtcgtcagctcgtgtcgtgagatgttgggttaagtcccgcaacgagcgcaacccttatcctttgttgccagcacgtaatggtgggaactcaagggagactgccgcagacaatgcggaggaaggcggggatgacgtcaagtcatcatgccccttatgtcctgggctacacacgtactacaatgggcttaaacaaagcgaagcaagcccgcgagggtaagccaaacgcataaacaagctctcagttcggatcggaggctgcaactcgcctccgtgaagtcggaatcgctagtaatcgcaggtcagcatactgcggtgaatacgttcccgggccttgtacacaccgcccgtcacaccacgaaagttgacaacacccgaagccggtggggtaaccgattcgacattggattttcgacatacgacaatcgaaaggaaagacgaaagtcttgcaagaacccaatcgaaagtcaaaggtcgaaggtcgaatgtcgaaccggggctagccgtctaaggtgggnccgatgattggggtgaagtcgtaacaaggtagccgtatcggaaggtgcggctggatcacctcctttctagggaga

SEQ ID NO: 8753 - DNA, 1563 bp, Sporomusaceae bacterium
  ref <308>: DATABASE ACCESSION NUMBER: NCBI ACCESSION: NZ_BIFV01000027.1
  ref <309>: DATABASE ENTRY DATE: 2019-04-01
  ref <313>: RELEVANT RESIDUES IN SEQ ID NO: (1)..(1563)
tttatggagagtttgatcctggctcaggacgaacgctggcggcgtgcctaacacatgcaagtcgaacggagaatcagcaatggttcttagtggcgaacgggtgagtaacgcgtagacaacctgccttctagatggggacaacactgcgaaagtggtgctaataccgaatgttgtaataagcctgcatgggcttgatactaaaggtggcctctgacataagctatcactagaagatgggtctgcgtctgattagctagttggtgaggtaatggctcaccaaggcgatgatcagtagccggtctgagaggatgaacggccacactgggactgagacacggcccagactcctacgggaggcagcagtggggaatcttccgcaatggacgaaagtctgacggagcaacgccgcgtgagtgaagaaggttttcggatcgtaaagctctgtctttgaggacgaatgtgtttaatgtgaataatgttagataatgacggtactcgaggaggaagccacggctaactacgtgccagcagccgcggtaatacgtaggtggcaagcgttgtccggaattattgggcgtaaagcgcgcgcaggcgggatattaagtctgttttaaaagttcggggctcaaccccgtgatggaatggaaactaatattcttgagtgcaggagaggaaagtggaattcccagtgtagcggtgaaatgcgtagatattgggaggaacaccagtggcgaaggcgactttctggactgtgtctgacgctgaggcgcgaaagccaggggagtgaacgggattagataccccggtaatcctggccgtaaacgatgggtactaggtgtaggaggtatcgaccccttctgtgccggagttaacgcaataagtaccccgcctggggagtacggccgcaaggttgaaactcaaaggaattgacgggggcccgcacaagcggtggagtatgtggtttaattcgacgcaacgcgaagaaccttaccaggacttgacatcgattgaaagttctagagatagaacccttcccttcggggaacaagaagacaggtggtgcatggctgtcgtcagctcgtgtcgtgagatgttgggttaagtcccgcaacgagcgcaacccttatcctatgttgccagcacgtaaaggtgggaactcatgggagactgccgcagacaatgcggaggaaggcggggatgacgtcaagtcatcatgccccttatgtcctgggctacacacgtactacaatgggcttaaatagagggaagcgaagccgcgaggtgaagcgaaccccaaaaacaagctctcagttcggattgcaggctgcaactcgcctgcatgaagtcggaatcgctagtaatcgcagatcagcatgctgcggtgaatacgttcccgggccttgtacacaccgcccgtcacaccacgagagttggaaacacccgaagccggtgaggtaaccttttaggagccagccgtctaaggtggggccgatgattggggtgaagtcgtaacaaggtagccgtatcggaaggtgcggctggatcacctcctttctaaggaga

SEQ ID NO: 8754 - DNA, 1555 bp, Sporosarcina globispora
  ref <308>: DATABASE ACCESSION NUMBER: NCBI ACCESSION: NZ_LGUF01000007.1
  ref <309>: DATABASE ENTRY DATE: 2019-04-01
  ref <313>: RELEVANT RESIDUES IN SEQ ID NO: (1)..(1555)
ttatatggagagtttgatcctggctcaggacgaacgctggcggcgtgcctaatacatgcaagtcgagcggacagatgggagcttgctccctgaagtcagcggcggacgggtgagtaacacgtgggcaacctgcctgtaagactgggataactccgggaaaccggggctaataccggataattctttccctcacatgaggggaagctgaaagatggtttcggctatcgcttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccccggctcaaccggggagggtcattggaaactggggaacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaaccctagagatagggcgttccccttcgggggacaggatgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcgagaccgcgaggttaagcgaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttctaa

SEQ ID NO: 8755 - DNA, 636 bp, Sporosarcina koreensis
  ref <308>: DATABASE ACCESSION NUMBER: NCBI ACCESSION: NZ_LQYA01000048.1
  ref <309>: DATABASE ENTRY DATE: 2019-04-01
  ref <313>: RELEVANT RESIDUES IN SEQ ID NO: (1)..(636)
ggctaataccgaataatcggttcttccgcatggaagaactctgaaagacggtttcggctgtcactgcaggatgggcccgcggcgcattagctagttggtggggtaacggcctaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgaagaaggttttcggatcgtaaagctctgttgcgagggaagaacaagtacgggagtaactgcccgtaccttgacggtacctcgtcagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagat

SEQ ID NO: 8756 - DNA, 291 bp, Sporosarcina newyorkensis
  ref <308>: DATABASE ACCESSION NUMBER: NCBI ACCESSION: NZ_FUYJ01000007.1
  ref <309>: DATABASE ENTRY DATE: 2019-04-01
  ref <313>: RELEVANT RESIDUES IN SEQ ID NO: (1)..(291)
ttttatggagagtttgatcctggctcaggacgaacgctggcggcgtgcctaatacatgcaagtcgagcgaatctttgggagcttgctcctaaagattagcggcggacgggtgagtaacacgtgggcaacctaccttacagatggggataactccgggaaaccggggctaataccgaataatccatttattcgcatgaagagatgttgaaagacggtttcggctgtcactgtgagatgggcccgcggcgcattagttagttggtggggtaacggcctaccaagaccacgatg

SEQ ID NO: 8757 - DNA, 1558 bp, Sporosarcina pasteurii
  ref <308>: DATABASE ACCESSION NUMBER: NCBI ACCESSION: NZ_UGYZ01000002.1
  ref <309>: DATABASE ENTRY DATE: 2019-04-01
  ref <313>: RELEVANT RESIDUES IN SEQ ID NO: (1)..(1558)
attatggagagtttgatcctggctcaggacgaacgctggcggcgtgcctaatacatgcaagtcgagcgaacaaaggaagaaacttgtttcttcctttgttagcggcggatgggtgagtaacacgtgggcaacctgccctgcagttggggataactccgggaaaccggggctaataccgaataatcagttccttcgcatgaaggaactctgaaagacggctatgctgtcactgcaggatgggcccgcggcgcattagctagttggtgaggtaatggcttaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgaagaaggttttcggatcgtaaagctctgttgtgagggaagaacaagtacaggagtaactgcctgtaccttgacggtacctcattagaaagccacggctaactacgtgccagcagccgcggtaatacgtaggtggcaagcgttgtccggaattattgggcgtaaagcgcgcgcaggcggccttttaagtctgatgtgaaagcccacggcttaaccgtggaaggtcattggaaactggaaggcttgagtacagaagaggaaagcggaattccacgtgtagcggtgaaatgcgtagagatgtggaggaacaccagtggcgaaggcggctttctggtctgtaactgacgctgaggcgcgaaagcatggggagcaaacaggattagataccctggtagtccatgccgtaaacgatgagtgctaagtgttagggggtttccgccccttagtgctggagcaaacgcattaagcactccgcctggggagtacggccgcaaggctgaaactcaaaggaattgacggggacccgcacaagcggtggagcatgtggtttaattcgaagctacgcgaagaaccttaccaggtcttgacatcccgttgaccggtatagagatatacctttcccttcggggacagcggtgacaggtggtgcatggttgtcgtcagctcgtgtcgtgagatgttgggttaagtcccgtaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggacggtacagagggttgccaacccgcgagggggagctaatcccataaaaccgttcccagttcggattgcaggctgcaactcgcctgcatgaagcaggaatcgctagtaatcgtggatcagcatgccacggtgaatacgttcccgggtcttgtacacaccgcccgtcacaccacgagagtttgtaacacccgaagtcggtggggtaacccttttgggagccagccgccgaaggtgggacagatgattggggtgaagtcgtaacaaggtagccgtatcggaaggtgcggctggatcacctcctttcta

SEQ ID NO: 8758 - DNA, 1558 bp, Sporosarcina psychrophila
  ref <308>: DATABASE ACCESSION NUMBER: NCBI ACCESSION: NZ_CP014616.1
  ref <309>: DATABASE ENTRY DATE: 2019-04-01
  ref <313>: RELEVANT RESIDUES IN SEQ ID NO: (1)..(1558)
ctattatggagagtttgatcctggctcaggacgaacgctggcggcatgcctaatacatgcaagtcgagcggaatgatgagagcttgctctctgattttagcggcggacgggtgagtaacacgtgggcaacctgccctacagatggggataactccgggaaaccggggctaataccgaataatcagtttgtccgcatggacaaactctgaaagacggtttcggctgtcactgtaggatgggcccgcggcgcattagctagttggtggggtaatggcctaccaaggcaacgatgcgtagccgacctgagagggtgatcggccacactgggactgagacacggcccagactcctacgggaggcagcagtagggaatcttccacaatggacgaaagtctgatggagcaatgccgcgtgagcgaagaaggttttcggatcgtaaagctctgttgtaagggaagaacacgtacgggagtaactgcccgtgccatgacggtaccttattagaaagccacggctaactacgtgccagcagccgcggtaatacgtaggtggcaagcgttgtccggaattattgggcgtaaagcgcgcgcaggcggttctttaagtctgatgtgaaagcccacggctcaaccgtggagggtcattggaaactggagaacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccactgaccggtgtagagatacgcctttcccttcggggacagtggtgacaggtggtgcatggttgtcgtcagctcgtgtcgtgagatgttgggttaagtcccgcaacgagcgcaacccttgatcttagttgccagcattcagttgggcactctaaggtgactgccggtgataaaccggaggaaggtggggatgacgtcaaatcatcatgccccttatgacctgggctacacacgtgctacaatggatgatacagagggttgccaacccgcgagggggagccaatcccataaaatcattcccagttcggattggaggctgcaactcgcctccatgaagccggaatcgctagtaatcgtggatcagcatgccacggtgaatacgttcccgggtcttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttctaa

SEQ ID NO: 8759 - DNA, 1479 bp, Sporosarcina sp. D27
  ref <308>: DATABASE ACCESSION NUMBER: NCBI ACCESSION: NZ_AZUC01000041.1
  ref <309>: DATABASE ENTRY DATE: 2019-04-01
  ref <313>: RELEVANT RESIDUES IN SEQ ID NO: (1)..(1479)
ggagcttgctccttgagattagcggcggacgggtgagtaacacgtgggcaacctgccctgcagatggggataactccgggaaaccggggctaataccgaataatcagttccttcgcatgaaggaactctgaaagacggtttcggctgtcactgcaggatgggcccgcggcgcattagctagttggtggggtaatggcctaccaaggcaacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgcgagggaagaacatgtacgggagtaactgcccgtaccttgacggtacctcgtcagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccactgaccggcatggagacatgtctttcccttcggggacagtggtgacaggtggtgcatggttgtcgtcagctcgtgtcgtgagatgttgggttaagtcccgcaacgagcgcaacccttaatcttagttgccatcatttagttgggcactctaaggtgactgccggtgacaaaccggaggaaggtggggatgacgtcaaatcatcatgccccttatgacctgggctacacacgtgctacaatggacggtacagagggctgcaaacccgcgagggggagccaatcccagaaaaccgttcccagttcggattgtaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttcta

SEQ ID NO: 8760 - DNA, 1561 bp, Sporosarcina sp. EUR3 2.2.2
  ref <308>: DATABASE ACCESSION NUMBER: NCBI ACCESSION: NZ_AXVE01000001.1
  ref <309>: DATABASE ENTRY DATE: 2019-04-01
  ref <313>: RELEVANT RESIDUES IN SEQ ID NO: (1)..(1561)
ctattatggagagtttgatcctggctcaggacgaacgctggcggcgtgcctaatacatgcaagtcgagcggaatgatgaagaagcttgcttcttctgattttagcggcggacgggtgagtaacacgtgggcaacctaccttgtagattgggataactccgggaaaccggggctaataccgaataatccattttgcttcatggcgaaatgttgaaaggcggcttcggctgtcactacgagatgggcccgcggcgtattagctagttggtagggtaatggcctaccaaggcgacgatacgtagccgacctgagagggtgatcggccacactgggactgagacacggcccagactcctacgggaggcagcagtagggaatcttccacaatggacgaaagtctgatggagcaacgccgcgtgagtgaagaaggttttcggatcgtaaaactctgttgtaagggaagaacacgtacgagagtaactgctcgtaccttgacggtaccttattagaaagccacggctaactacgtgccagcagccgcggtaatacgtaggtggcaagcgttgtccggaattattgggcgtaaagcgcgcgcaggcggttctttaagtctgatgtgaaagcccacggctcaaccgtggagggtcattggaaactggagaacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccactgaccggtttagagataagcctttcccttcggggacagtggtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacgatacaaagggctgcaaacccgcgagggggagccaatcccataaaatcgttctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggggaggtaacctttacaggagccagccgccgaaggtgggacagatgattggggtgaagtcgtaacaaggtagccgtatcggaaggtgcggctggatcacctcctttcta

SEQ ID NO: 8761 - DNA, 1554 bp, Sporosarcina sp. P13
  ref <308>: DATABASE ACCESSION NUMBER: NCBI ACCESSION: NZ_PDYM01000080.1
  ref <309>: DATABASE ENTRY DATE: 2019-04-01
  ref <313>: RELEVANT RESIDUES IN SEQ ID NO: (1)..(1554)
ttatggagagtttgatcctggctcaggacgaacgctggcggcatgcctaatacatgcaagtcgagcgaacagttagaagcttgcttctaactgttagcggcggacgggtgagtaacacgtgggcaacctaccttacagatggggataactccgggaaaccggggctaataccgaataatccattttcctgcatgggagaatgttgaaagacggtttcggctgtcactgtaagatgggcccgcggcgcattagctagttggtgaggtaacggctcaccaaggccacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtacaggagtaactgcctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccagtgaccgtcatggagacatgattttcccttcggggacactggtgacaggtggtgcatggttgtcgtcagctcgtgtcgtgagatgttgggttaagtcccgcaacgagcgcaacccttaatgttagttgccatcattcagttgggcactctaatgtgactgccggtgacaaaccggaggaaggtggggatgacgtcaaatcatcatgccccttatgacctgggctacacacgtgctacaatggacggtacagagggctgcaaacccgcgagggggagccaatcccagaaaaccgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttcta

SEQ ID NO: 8762 - DNA, 1554 bp, Sporosarcina sp. P16b
  ref <308>: DATABASE ACCESSION NUMBER: NCBI ACCESSION: NZ_PDYO01000040.1
  ref <309>: DATABASE ENTRY DATE: 2019-04-01
  ref <313>: RELEVANT RESIDUES IN SEQ ID NO: (1)..(1554)
ttatggagagtttgatcctggctcaggacgaacgctggcggcatgcctaatacatgcaagtcgagcgaactgttggaagcttgcttccttcagttagcggcggacgggtgagtaacacgtgggcaacctgcccttcagatggggataactccgggaaaccggggctaataccgaataatccattttctcgcatgaggaaatgttgaaagacggtttcggctgtcactgaaggatgggcccgcggcgcattagctagttggtggggtaatggctcaccaaggccacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtacaggagtaactgcctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccagtgaccgtcatggagacatgattttcccttcggggacactggtgacaggtggtgcatggttgtcgtcagctcgtgtcgtgagatgttgggttaagtcccgcaacgagcgcaacccttaatgttagttgccatcatttagttgggcactctaatgtgactgccggtgacaaaccggaggaaggtggggatgacgtcaaatcatcatgccccttatgacctgggctacacacgtgctacaatggacgatacagagggctgcaaacccgcgagggggagccaatcccagaaaatcgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttaggggagctagccgccgaaggtgggacagatgattggggtgaagtcgtaacaaggtagccgtatcggaaggtgcggctggatcacctcctttcta

SEQ ID NO: 8763 - DNA, 1489 bp, Sporosarcina sp. P18a
  ref <308>: DATABASE ACCESSION NUMBER: NCBI ACCESSION: NZ_PDYQ01000016.1
  ref <309>: DATABASE ENTRY DATE: 2019-04-01
  ref <313>: RELEVANT RESIDUES IN SEQ ID NO: (1)..(1489)
cgaactgttggaagcttgcttccttcagttagcggcggacgggtgagtaacacgtgggcaacctgcccttcagatggggataactccgggaaaccggggctaataccgaataatccattttctcgcatgaggagatgttgaaagacggtttcggctgtcactgaaggatgggcccgcggcgcattagctagttggtggggtaatggctcaccaaggccacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtacaggagtaactgcctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccagtgaccgtcatggagacatgattttcccttcggggacactggtgacaggtggtgcatggttgtcgtcagctcgtgtcgtgagatgttgggttaagtcccgcaacgagcgcaacccttaatgttagttgccatcatttagttgggcactctaatgtgactgccggtgacaaaccggaggaaggtggggatgacgtcaaatcatcatgccccttatgacctgggctacacacgtgctacaatggacgatacagagggctgcaaacccgcgagggggagccaatcccagaaaatcgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttaggggagctagccgccgaaggtgggacagatgattggggtgaagtcgtaacaaggtagccgtatcggaaggtgcggctggatcacctcctttcta

SEQ ID NO: 8764 - DNA, 1554 bp, Sporosarcina sp. P2
  ref <308>: DATABASE ACCESSION NUMBER: NCBI ACCESSION: NZ_PDYY01000027.1
  ref <309>: DATABASE ENTRY DATE: 2019-04-01
  ref <313>: RELEVANT RESIDUES IN SEQ ID NO: (1)..(1554)
ttatggagagtttgatcctggctcaggacgaacgctggcggcatgcctaatacatgcaagtcgagcgaactgttggaagcttgcttccttcagttagcggcggacgggtgagtaacacgtgggcaacctgcccttcagatggggataactccgggaaaccggggctaataccgaataatccatttcttcgcatgaggagatgttgaaagacggtttcggctgtcactgaaggatgggcccgcggcgcattagctagttggtggggtaatggctcaccaaggccacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtacaggagtaactgcctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccagtgaccgtcatggagacatgattttcccttcggggacactggtgacaggtggtgcatggttgtcgtcagctcgtgtcgtgagatgttgggttaagtcccgcaacgagcgcaacccttaatgttagttgccatcatttagttgggcactctaatgtgactgccggtgacaaaccggaggaaggtggggatgacgtcaaatcatcatgccccttatgacctgggctacacacgtgctacaatggacgatacagagggctgcaaacccgcgagggggagccaatcccagaaaatcgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttaggggagctagccgccgaaggtgggacagatgattggggtgaagtcgtaacaaggtagccgtatcggaaggtgcggctggatcacctcctttcta

SEQ ID NO: 8765 - DNA, 1557 bp, Sporosarcina sp. P33
  ref <308>: DATABASE ACCESSION NUMBER: NCBI ACCESSION: NZ_CP015027.1
  ref <309>: DATABASE ENTRY DATE: 2019-04-01
  ref <313>: RELEVANT RESIDUES IN SEQ ID NO: (1)..(1557)
tcttatggagagtttgatcctggctcaggacgaacgctggcggcatgcctaatacatgcaagtcgagcgaactgttggaagcttgcttccaacagttagcggcggacgggtgagtaacacgtgggcaacctgcccttcagatggggataactccgggaaaccggggctaataccgaataatccatttcttcgcatgaagagatgttgaaagacggcgtttcgctgtcactgaaggatgggcccgcggcgcattagctagttggtggggtaacggcctaccaaggcgacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtacaggagtaactgcctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccactgaccggcatggagacatgcctttcccttcggggacagtggtgacaggtggtgcatggttgtcgtcagctcgtgtcgtgagatgttgggttaagtcccgcaacgagcgcaacccttaatcttagttgccatcattcagttgggcactctaaggtgactgccggtgacaaaccggaggaaggtggggatgacgtcaaatcatcatgccccttatgacctgggctacacacgtgctacaatggacgatacagagggctgcaaacccgcgagggggagccaatcccacaaaatcgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccgtacgggagccagccgccgaaggtgggacagatgattggggtgaagtcgtaacaaggtagccgtatcggaaggtgcggctggatcacctcctttcta

SEQ ID NO: 8766 - DNA, 1555 bp, Sporosarcina sp. P34
  ref <308>: DATABASE ACCESSION NUMBER: NCBI ACCESSION: NZ_PDZC01000022.1
  ref <309>: DATABASE ENTRY DATE: 2019-04-01
  ref <313>: RELEVANT RESIDUES IN SEQ ID NO: (1)..(1555)
ttatggagagtttgatcctggctcaggacgaacgctggcggcatgcctaatacatgcaagtcgagcgaactgttggaagcttgcttccttcagttagcggcggacgggtgagtaacacgtgggcaacctgcccttcagatggggataactccgggaaaccggggctaataccgaataatccattttctcgcatgaggaaatgttgaaagacggcatctcgctgtcactgaaggatgggcccgcggcgcattagctagttggtggggtaatggctcaccaaggccacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtacaggagtaactgcctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccagtgaccgtcatggagacatgattttcccttcggggacactggtgacaggtggtgcatggttgtcgtcagctcgtgtcgtgagatgttgggttaagtcccgcaacgagcgcaacccttaatgttagttgccatcatttagttgggcactctaatgtgactgccggtgacaaaccggaggaaggtggggatgacgtcaaatcatcatgccccttatgacctgggctacacacgtgctacaatggacgatacagagggctgcaaacccgcgagggggagccaatcccagaaaatcgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttaggggagctagccgccgaaggtgggacagatgattggggtgaagtcgtaacaaggtagccgtatcggaaggtgcggctggatcacctcctttcta

SEQ ID NO: 8767 - DNA, 1559 bp, Sporosarcina sp. P37
  ref <308>: DATABASE ACCESSION NUMBER: NCBI ACCESSION: NZ_CP015349.1
  ref <309>: DATABASE ENTRY DATE: 2019-04-01
  ref <313>: RELEVANT RESIDUES IN SEQ ID NO: (1)..(1559)
ctcttatggagagtttgatcctggctcaggacgaacgctggcggcatgcctaatacatgcaagtcgagcgaactgttggaagcttgcttctaacagttagcggcggacgggtgagtaacacgtgggcaacctgcccttcagatggggataactccgggaaaccggggctaataccgaataatccatttcttcgcatgaagagatgttgaaagacggcgtttcgctgtcactgaaggatgggcccgcggcgcattagctagttggtggggtaacggcctaccaaggcaacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtacaggagtaactgcctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccactgaccggcatggagacatgcctttcccttcggggacagtggtgacaggtggtgcatggttgtcgtcagctcgtgtcgtgagatgttgggttaagtcccgcaacgagcgcaacccttaatcttagttgccatcattcagttgggcactctaaggtgactgccggtgacaaaccggaggaaggtggggatgacgtcaaatcatcatgccccttatgacctgggctacacacgtgctacaatggacgatacagagggctgcaaacccgcgagggggagccaatcccacaaaatcgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttctaa

SEQ ID NO: 8768 - DNA, 1554 bp, Sporosarcina sp. P7; identical to SEQ ID NO: 8762
  ref <308>: DATABASE ACCESSION NUMBER: NCBI ACCESSION: NZ_PDZF01000035.1
  ref <309>: DATABASE ENTRY DATE: 2019-04-01
  ref <313>: RELEVANT RESIDUES IN SEQ ID NO: (1)..(1554)

SEQ ID NO: 8769 - DNA, 1480 bp, Sporosarcina sp. ZBG7A
  ref <308>: DATABASE ACCESSION NUMBER: NCBI ACCESSION: NZ_JWIB01000047.1
  ref <309>: DATABASE ENTRY DATE: 2019-04-01
  ref <313>: RELEVANT RESIDUES IN SEQ ID NO: (1)..(1480)
aggagcttgctccttgagattagcggcggacgggtgagtaacacgtgggcaacctgccctgcagatggggataactccgggaaaccggggctaataccgaataatcaattccttcgcatgaaggaattctgaaagacggtttcggctgtcactgcaggatgggcccgcggcgcattagctagttggtggggtaatggcctaccaaggcaacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgcgagggaagaacacgtacgggagtaactgcccgtaccttgacggtacctcgtcagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccactgaccggcatggagacatgtctttcccttcggggacagtggtgacaggtggtgcatggttgtcgtcagctcgtgtcgtgagatgttgggttaagtcccgcaacgagcgcaacccttaatcttagttgccatcatttagttgggcactctaaggtgactgccggtgacaaaccggaggaaggtggggatgacgtcaaatcatcatgccccttatgacctgggctacacacgtgctacaatggacggtacagagggctgcaaacccgcgagggggagccaatcccagaaaaccgttcccagttcggattgtaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttcta

SEQ ID NO: 8770 - DNA, 1557 bp, Sporosarcina ureae
  ref <308>: DATABASE ACCESSION NUMBER: NCBI ACCESSION: NZ_CP015348.1
  ref <309>: DATABASE ENTRY DATE: 2019-04-01
  ref <313>: RELEVANT RESIDUES IN SEQ ID NO: (1)..(1557)
tattatggagagtttgatcctggctcaggacgaacgctggcggcatgcctaatacatgcaagtcgagcgaactgttggaagcttgcttccttcagttagcggcggacgggtgagtaacacgtgggcaacctgcccttcagatggggataactccgggaaaccggggctaataccgaataatccatcctctcgcatgagaggatgttgaaagacggcatctcgctgtcactgaaggatgggcccgcggcgcattagctagttggtggggtaatggctcaccaaggccacgatgcgtagccgacctgagagggtgatcggccacactgggactgagacacggcccagactcctacgggaggcagcagtagggaatcttccacaatggacgaaagtctgatggagcaatgccgcgtgagtgaagaaggttttcggatcgtaaagctctgttgtaagggaagaacaagtacaggagtaactgcctgtaccttgacggtaccttaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcccagtgaccgtcatggagacatgattttcccttcggggacactggtgacaggtggtgcatggttgtcgtcagctcgtgtcgtgagatgttgggttaagtcccgcaacgagcgcaacccttaatgttagttgccatcattcagttgggcactctaatgtgactgccggtgacaaaccggaggaaggtggggatgacgtcaaatcatcatgccccttatgacctgggctacacacgtgctacaatggacgatacagagggctgcaaacccgcgagggggagccaatcccacaaaatcgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttaggggagctagccgccgaaggtgggacagatgattggggtgaagtcgtaacaaggtagccgtatcggaaggtgcggctggatcacctcctttcta

SEQ ID NO: 8771 - DNA, 1498 bp, Stanieria cyanosphaera
  ref <308>: DATABASE ACCESSION NUMBER: NCBI ACCESSION: NC_019748.1
  ref <309>: DATABASE ENTRY DATE: 2019-04-01
  ref <313>: RELEVANT RESIDUES IN SEQ ID NO: (1)..(1498)
catggagagtttgatcctggctcaggatgaacgctggcggtatgcctaacacatgcaagtcgaacgggaatccttcgggattctagtggcggacgggtgagtaacgcgtgagaatctgccttcaggacggggataacagttggaaacgactgctaatacccgatgtgccgaaaggtaaaagtaattcgcctgaagaggagctcgcgtccgattagctagttggtgtggtaagagcgcaccaaggcgacgatcggtagctggtctgagaggatgagcagccacactgggactgagacacggcccagactcctacgggaggcagcagtggggaattttccgcaatgggcgaaagcctgacggagcaataccgcgtgagggaggaaggcctttgggttgtaaacctcttttctcaaggaagaagttctgacggtacttgaggaatcagcatcggctaactccgtgccagcagccgcggtaatacggaggatgcaagcgttatccggaattattgggcgtaaagcgtccgcaggcggtttcacaagtctgctgtcaaagactggagcttaactccgggcaggcggtggaaactgtgaaactagagtacggtaggggtagagggaattcccagtgtagcggtgaaatgcgtagagattgggaagaacaccagtggcgaaggcgctctactgggccgtaactgacgctcagggacgaaagctaggggagcgaaagggattagatacccctgtagtcctagctgtaaacgatggatactaggcgttgcttgtatcgacccgagcagtgccgcagctaacgcgttaagtatcccgcctggggagtacgcacgcaagtgtgaaactcaaaggaattgacgggggcccgcacaagcggtggagtatgtggtttaattcgatgcaacgcgaagaaccttaccaggacttgacatgtcgcgaatcactaggaaactagagagtgccttcgggagcgcgaacacaggtggtgcatggctgtcgtcagctcgtgtcgtgagatgttgggttaagtcccgcaacgagcgcaaccctcgttcttagttgccagcagttaggctgggcactctaggaagactgccggtgacaaaccggaggaaggtggggatgacgtcaagtcagcatgccccttacgtcctgggctacacacgtactacaatggtagggacaaagggcagcaagctcgcaagagtaagcgaatctcagcaaaccctgcctcagttcagattgcaggctgcaactcgcctgcatgaaggaggaatcgctagtaatcgcaggtcagcatactgcggtgaatccgttcccgggccttgtacacaccgcccgtcacaccatggaagctggccacgcccgaagtcgttaccctaacccgtaagggagggggatgccgaaggcagggctagtgactggggtgaagtcgtaacaaggtagccgtaccggaaggtgtggctggatcacctcctttttaggga

SEQ ID NO: 8772 - DNA, 1494 bp, Stanieria sp. NIES-3757
  ref <308>: DATABASE ACCESSION NUMBER: NCBI ACCESSION: NZ_AP017375.1
  ref <309>: DATABASE ENTRY DATE: 2019-04-01
  ref <313>: RELEVANT RESIDUES IN SEQ ID NO: (1)..(1494)
catggagagtttgatcctggctcaggatgaacgctggcggtatgcctaacacatgcaagtcgaacgagctcttcggagctagtggcggacgggtgagtaacgcgtgagaatctgccttcaggacggggataacagttggaaacgactgctaatacccgatgtgccgcaaggtgaaagtaattcgcctgaagaggagctcgcgtccgattagctagttggtgtggtaagagcgcaccaaggcaacgatcggtagctggtctgagaggatgagcagccacactgggactgagacacggcccagactcctacgggaggcagcagtggggaattttccgcaatgggcgaaagcctgacggagcaataccgcgtgagggaggaaggcctttgggttgtaaacctcttttctcaaggaagaagttctgacggtacttgaggaatcagcatcggctaactccgtgccagcagccgcggtaatacggaggatgcaagcgttatccggaattattgggcgtaaagcgtccgcaggcggtttcacaagtctgctgtcaaagactggagcttaactccgggcaggcggtggaaactgtgaaactagagtacggtaggggtagagggaattcccagtgtagcggtgaaatgcgtagagattgggaagaacaccagtggcgaaggcgctctactgggccgtaactgacgctcagggacgaaagctaggggagcgaaagggattagatacccctgtagtcctagctgtaaacgatggatactaggcgttgcttgtatcgacccgagcagtgccgcagctaacgcgttaagtatcccgcctggggagtacgcacgcaagtgtgaaactcaaaggaattgacgggggcccgcacaagcggtggagtatgtggtttaattcgatgcaacgcgaagaaccttaccaggacttgacatgtcgcgaatctctgggaaactagagagtgccttcgggagcgcgaacacaggtggtgcatggctgtcgtcagctcgtgtcgtgagatgttgggttaagtcccgcaacgagcgcaaccctcgttcttagttgccagcagttaggctgggcactctaggaagactgccggtgacaaaccggaggaaggtggggatgacgtcaagtcagcatgccccttacgtcctgggctacacacgtactacaatggtagggacaaagggcagcaagctcgcaagagtaagcgaatctcagcaaaccctgcctcagttcagattgcaggctgcaactcgcctgcatgaaggaggaatcgctagtaatcgcaggtcagcatactgcggtgaatccgttcccgggccttgtacacaccgcccgtcacaccatggaagctggccacgcccgaagtcgttaccctaaccgttcgcggagggggatgccgaaggcagggctagtgactggggtgaagtcgtaacaaggtagccgtaccggaaggtgtggctggatcacctcctttttaggga

SEQ ID NO: 8773 - DNA, 1554 bp, Staphylococcus agnetis
  ref <308>: DATABASE ACCESSION NUMBER: NCBI ACCESSION: NZ_PZEA01000075.1
  ref <309>: DATABASE ENTRY DATE: 2019-04-01
  ref <313>: RELEVANT RESIDUES IN SEQ ID NO: (1)..(1554)
tttatggagagtttgatcctggctcaggatgaacgctggcggcgtgcctaatacatgcaagtcgagcgaactgacgaggagcttgctcctttgacgttagcggcggacgggtgagtaacacgtgggtaacctacctataagactggaataactccgggaaaccggggctaatgccggataacatgttgaaccgcatggttcaacagtgaaagacggtcttgctgtcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaagctctgttgttagggaagaacatatgtgtaagtaactgtgcacatcttgacggtacctaaccagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcggctttctggtctgtaactgacgctgaggtgcgaaagcgtggggatcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcttttgaccgctctagagatagagttttcctcttcggaggacaaaatgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccattttggagctagccgtcgaaggtgggacaaatgattggggtgaagtcgtaacaaggtagccgtatcggaaggtgcggctggatcacctcctttct

SEQ ID NO: 8774 - DNA, 1556 bp, Staphylococcus argensis
  ref <308>: DATABASE ACCESSION NUMBER: NCBI ACCESSION: NZ_PPPX01000013.1
  ref <309>: DATABASE ENTRY DATE: 2019-04-01
  ref <313>: RELEVANT RESIDUES IN SEQ ID NO: (1)..(1556)
tttatggagagtttgatcctggctcaggatgaacgctggcggcgtgcctaatacatgcaagtcgagcgaacagacggggagcttgctcccccgacgttagcggcggacgggtgagtaacacgtgggtaacctacctataagactggaataactccgggaaaccggagctaatgccggataacatgttggaccgcatggtcctacagtgaaagacggtcttgctgtcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggccttcgggtcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcaggagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgccccctctagagatagaggtttccccttcgggggacaaagtgacaggtggtgcatggttgtcgtcagctcgtgtcgtgagatgttgggttaagtcccgcaacgagcgcaacccttaagcttagttgccatcattcagttgggcactctaagttgactgccggtgacaaaccggaggaaggtggggatgacgtcaaatcatcatgccccttatgatttgggctacacacgtgctacaatggacaatacaaagggcagctaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagcaaccactttgtggagctagccgtcgaaggtgggacaaatgattggggtgaagtcgtaacaaggtagccgtatcggaaggtgcggctggatcacctcctttct

SEQ ID NO: 8775 - DNA, 1554 bp, Staphylococcus argenteus
  ref <308>: DATABASE ACCESSION NUMBER: NCBI ACCESSION: NZ_UGZA01000002.1
  ref <309>: DATABASE ENTRY DATE: 2019-04-01
  ref <313>: RELEVANT RESIDUES IN SEQ ID NO: (1)..(1554)
tttatggagagtttgatcctggctcaggatgaacgctggcggcgtgcctaatacatgcaagtcgagcgaacggacgagaagcttgcttctctgatgttagcggcggacgggtgagtaacacgtggataacctacctataagactgggataacttcgggaaaccggagctaataccggataatattttgaaccgcatggttcaaaagtgaaagacggtcttgctgtcacttatagatggatccgcgctgcattagctagttggtaaggtaacggcttaccaaggcaacgatgcatagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatatgtgtaagtaactgtgcacatcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacaaatgattggggtgaagtcgtaacaaggtagccgtatcggaaggtgcggctggatcacctcctttct

SEQ ID NO: 8776 - DNA, 1555 bp, Staphylococcus arlettae
  ref <308>: DATABASE ACCESSION NUMBER: NCBI ACCESSION: NZ_UGZE01000001.1
  ref <309>: DATABASE ENTRY DATE: 2019-04-01
  ref <313>: RELEVANT RESIDUES IN SEQ ID NO: (1)..(1555)
tttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactggaataactccgggaaaccggggctaatgccggataacatttagaaccgcatggttctaaagtgaaagatggttttgctatcacttatagatggacccgcgccgtattagctagttggtaaggtaatggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaagggtttcggctcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggagacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccactctagagatagagctttccccttcgggggacaaagtgacaggtggtgcatggttgtcgtcagctcgtgtcgtgagatgttgggttaagtcccgcaacgagcgcaacccttaaacttagttgccagcatttagttgggcactctaggttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaaggtagccgtatcggaaggtgcggctggatcacctcctttct

SEQ ID NO: 8777 - DNA, 1554 bp, Staphylococcus aureus; identical to SEQ ID NO: 8775
  ref <308>: DATABASE ACCESSION NUMBER: NCBI ACCESSION: NZ_LR134351.1
  ref <309>: DATABASE ENTRY DATE: 2019-04-01
  ref <313>: RELEVANT RESIDUES IN SEQ ID NO: (1)..(1554)

SEQ ID NO: 8778 - DNA, 1554 bp, Staphylococcus auricularis
  ref <308>: DATABASE ACCESSION NUMBER: NCBI ACCESSION: NZ_LS483491.1
  ref <309>: DATABASE ENTRY DATE: 2019-04-01
  ref <313>: RELEVANT RESIDUES IN SEQ ID NO: (1)..(1554)
ttatatggagagtttgatcctggctcaggatgaacgctggcggcgtgcctaatacatgcaagtcgagcgaacagataaggagcttgctcctttgacgttagcggcggacgggtgagtaacacgtgggtaacttacctataagactggaataactccgggaaaccggggctaatgccggataacatgttgaaccgcatggttctacagtgaaaggcggctttgctgtcacttatagatggacccgcgccgtattagctagttggtgaggtaacggctcaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgcgtaagtaactgtgcgcgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactgaaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggcttaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcattcagttgggcactctaagttgactgccggtgacaaaccggaggaaggtggagatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagtcggtagagtaaccttttggagctagccgccgaaggtgggacaaatgattggggtgaagtcgtaacaaggtagccgtatcggaaggtgcggctggatcacctcctttct

SEQ ID NO: 8779 - DNA, 1312 bp, Staphylococcus capitis
  ref <308>: DATABASE ACCESSION NUMBER: NCBI ACCESSION: NZ_CZWH01000013.1
  ref <309>: DATABASE ENTRY DATE: 2019-04-01
  ref <313>: RELEVANT RESIDUES IN SEQ ID NO: (1)..(1312)
gcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgaagaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgatcccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttggagctagccgtcgaaggtgggacaaatgattggggtgaagtcgtaacaaggtagccgtatcggaaggtgcggctggatcacctcctttctaagga

SEQ ID NO: 8780 - DNA, 1554 bp, Staphylococcus caprae
  ref <308>: DATABASE ACCESSION NUMBER: NCBI ACCESSION: NZ_UHCW01000005.1
  ref <309>: DATABASE ENTRY DATE: 2019-04-01
  ref <313>: RELEVANT RESIDUES IN SEQ ID NO: (1)..(1554)
tttatggagagtttgatcctggctcaggatgaacgctggcggcgtgcctaatacatgcaagtcgagcgaacagacgaggagcttgctcctctgacgttagcggcggacgggtgagtaacacgtggataacctacctataagattgggataacttcgggaaaccggagctaataccggataatatgttgaaccgcatggttcaacagtgaaagacggtcttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtggcgaaaccgcgaggtcaagcaaatcccataaagttgttctcagttcggattgtagtctgcaactcgactacatgaagctggaatcgctagtaatcgtggatcagcatgccacggtgaatacgttcccgggtcttgtacacaccgcccgtcacaccacgagagtttgtaacacccgaagccggtggagtaaccttttggagctagccgtcgaaggtgggacaaatgattggggtgaagtcgtaacaaggtagccgtatcggaaggtgcggctggatcacctcctttct

SEQ ID NO: 8781 - DNA, 1554 bp, Staphylococcus carnosus
  ref <308>: DATABASE ACCESSION NUMBER: NCBI ACCESSION: NZ_UHCT01000001.1
  ref <309>: DATABASE ENTRY DATE: 2019-04-01
  ref <313>: RELEVANT RESIDUES IN SEQ ID NO: (1)..(1554)
tttatggagagtttgatcctggctcaggatgaacgctggcggcgtgcctaatacatgcaagtcgagcgaacagacgaggagcttgctcctctgacgttagcggcggacgggtgagtaacacgtgggtaacctacctataagactggaataactccgggaaaccggggctaatgccggataatatgcagaaccgcatggttctgcaatgaaagacggttttgctgtcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaagtgcgtaggtaactatgcgcaccttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacagtacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagttcgtaacacccgaagccggtggagtaaccttttaggagctagccgtcgaaggtgggacgaatgattggggtgaagtcgtaacaaggtagccgtatcggaaggtgcggctggatcacctcctttct

SEQ ID NO: 8782 - DNA, 1553 bp, Staphylococcus chromogenes
  ref <308>: DATABASE ACCESSION NUMBER: NCBI ACCESSION: NZ_UHDB01000001.1
  ref <309>: DATABASE ENTRY DATE: 2019-04-01
  ref <313>: RELEVANT RESIDUES IN SEQ ID NO: (1)..(1553)
tttatggagagtttgatcctggctcaggatgaacgctggcggcgtgcctaatacatgcaagtcgagcgaactgacgaggagcttgctcctttgacgttagcggcggacgggtgagtaacacgtgggtaacctacctataagactggaataactccgggaaaccggggctaatgccggataacatatcgaaccgcatggttcgatagtgaaagacggtcttgctgtcacttatagatggacccgcgccgtattagctagttggtgaggtaacggctcaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaagctctgttgttagggaagaacaaatgtgtaagtaactgtgcacatcttgacggtacctaaccagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcggctttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcttttgaccactctagagatagagttttcctcttcggaggacaaaatgacaggtggtgcatggttgtcgtcagctcgtgtcgtgagatgttgggttaagtcccgcaacgagcgcaacccttgagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttct

SEQ ID NO: 8783 - DNA, 1555 bp, Staphylococcus cohnii
  ref <308>: DATABASE ACCESSION NUMBER: NCBI ACCESSION: NZ_UHDA01000001.1
  ref <309>: DATABASE ENTRY DATE: 2019-04-01
  ref <313>: RELEVANT RESIDUES IN SEQ ID NO: (1)..(1555)
tttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactggaataactccgggaaaccggggctaatgccggataacatttagaaccgcatggttctaaagtgaaagatggttttgctatcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaagcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaaacttagttgccagcatttagttgggcactctaagttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccgatggagtaaccatttatggagctagccgtcgaaggtgggacaaatgattggggtgaagtcgtaacaaggtagccgtatcggaaggtgcggctggatcacctcctttct

SEQ ID NO: 8784 - DNA, 1554 bp, Staphylococcus condimenti
  ref <308>: DATABASE ACCESSION NUMBER: NCBI ACCESSION: NZ_LR134360.1
  ref <309>: DATABASE ENTRY DATE: 2019-04-01
  ref <313>: RELEVANT RESIDUES IN SEQ ID NO: (1)..(1554)
tttatggagagtttgatcctggctcaggatgaacgctggcggcgtgcctaatacatgcaagtcgagcgaacagacgaggagcttgctcctctgacgttagcggcggacgggtgagtaacacgtgggtaacctacctataagactggaataactccgggaaaccggggctaatgccggataatatgcagaaccgcatggttctgcaatgaaagacggttttgctgtcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaagtgcgtaggtaactatgcgcaccttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacagtacaaagggcagcgaaaccgcgaggtcaagcaaatcccataaagctgttctcagttcggattgtagtctgcaactcgactacatgaagctggaatcgctagtaatcgtagatcagcatgctacggtgaatacgttcccgggtcttgtacacaccgcccgtcacaccacgagagttcgtaacacccgaagccggtggagtaaccttttaggagctagccgtcgaaggtgggacgaatgattggggtgaagtcgtaacaaggtagccgtatcggaaggtgcggctggatcacctcctttct

SEQ ID NO: 8785 - DNA, 1477 bp, Staphylococcus cornubiensis
  ref <308>: DATABASE ACCESSION NUMBER: NCBI ACCESSION: NZ_FXUZ01000029.1
  ref <309>: DATABASE ENTRY DATE: 2019-04-01
  ref <313>: RELEVANT RESIDUES IN SEQ ID NO: (1)..(1477)
aggagcttgctcctttgacgttagcggcggacgggtgagtaacacgtgggtaacctacctataagactggaataactccgggaaaccggggctaatgccggataacatgttgaaccgcatggttctacagtgaaagacggtcttgctgtcacttatagatggacccgcgccgtattagctagttggtggggtaacggcctaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaagctctgttgttagggaagaacaaatgtgtaagtaactgtgcacatcttgacggtacctaaccagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcggctttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcctttgaccgctctagagatagagttttcctcttcggaggacaaagtgacaggtggtgcatggttgtcgtcagctcgtgtcgtgagatgttgggttaagtcccgcaacgagcgcaacccttgagcttagttgccatcattaagttgggcactctaagttgactgccggtgacaaaccggaggaaggtggggatgacgtcaaatcatcatgccccttatgatttgggctacacacgtgctacaatggacaatacaaagggcagcaaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttct

SEQ ID NO: 8786 - DNA, 1554 bp, Staphylococcus delphini
  ref <308>: DATABASE ACCESSION NUMBER: NCBI ACCESSION: NZ_LR134263.1
  ref <309>: DATABASE ENTRY DATE: 2019-04-01
  ref <313>: RELEVANT RESIDUES IN SEQ ID NO: (1)..(1554)
tttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactggaataactccgggaaaccggggctaatgccggataacatgttgaaccgcatggttctacagtgaaagacggtcttgctgtcacttatagatggacccgcgccgtattagctagttggtggggtaacggcctaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaagctctgttgttagggaagaacaaatgtgtaagtaactgcgcacatcttgacggtacctaaccagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcggctttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcctttgacaactctagagatagagctttcctcttcggaggacaaagtgacaggtggtgcatggttgtcgtcagctcgtgtcgtgagatgttgggttaagtcccgcaacgagcgcaacccttgaacttagttgccatcattaagttgggcactctaagttgactgccggtgacaaaccggaggaaggtggggatgacgtcaaatcatcatgccccttatgatttgggctacacacgtgctacaatggacaatacaaagggcagcaaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccattttggagctagccgtcgaaggtgggacaaatgattggggtgaagtcgtaacaaggtagccgtatcggaaggtgcggctggatcacctcctttct

SEQ ID NO: 8787 - DNA, 1554 bp, Staphylococcus devriesei
  ref <308>: DATABASE ACCESSION NUMBER: NCBI ACCESSION: NZ_UHCZ01000002.1
  ref <309>: DATABASE ENTRY DATE: 2019-04-01
  ref <313>: RELEVANT RESIDUES IN SEQ ID NO: (1)..(1554)
tttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactgggataacttcgggaaaccggagctaataccggataatatttcgaaccgcatggttcgatagtgaaagatggttttgctatcacttatagatggacccgcgccgtattagctagttggtaaggtaacggcttaccaaggcaacgatacgtagccggcctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatacgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaatcccacgactcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagttttccccttcgggggacaaagtgacaggtggtgcatggttgtcgtcagctcgtgtcgtgagatgttgggttaagtcccgcaacgagcgcaacccttaaacttagttgccagcattcagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccattttggagctagccgtcgaaggtgggacaaatgattggggtgaagtcgtaacaaggtagccgtatcggaaggtgcggctggatcacctcctttct

SEQ ID NO: 8788 - DNA, 1555 bp, Staphylococcus edaphicus
  ref <308>: DATABASE ACCESSION NUMBER: NCBI ACCESSION: NZ_MRZN01000038.1
  ref <309>: DATABASE ENTRY DATE: 2019-04-01
  ref <313>: RELEVANT RESIDUES IN SEQ ID NO: (1)..(1555)
tttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactgggataacttcgggaaaccggagctaataccggataacatttggaaccgcatggttctaaagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaagggtttcggctcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaaaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaaggtagccgtatcggaaggtgcggctggatcacctcctttct

SEQ ID NO: 8789 - DNA, 1553 bp, Staphylococcus epidermidis
  ref <308>: DATABASE ACCESSION NUMBER: NCBI ACCESSION: NZ_LR134536.1
  ref <309>: DATABASE ENTRY DATE: 2019-04-01
  ref <313>: RELEVANT RESIDUES IN SEQ ID NO: (1)..(1553)
tttatggagagtttgatcctggctcaggatgaacgctggcggcgtgcctaatacatgcaagtcgagcgaacagacgaggagcttgctcctctgacgttagcggcggacgggtgagtaacacgtggataacctacctataagactgggataacttcgggaaaccggagctaataccggataatatattgaaccgcatggttcaatagtgaaagacggttttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttct

SEQ ID NO: 8790 - DNA, 1555 bp, Staphylococcus equorum
  ref <308>: DATABASE ACCESSION NUMBER: NCBI ACCESSION: NZ_UHDI01000003.1
  ref <309>: DATABASE ENTRY DATE: 2019-04-01
  ref <313>: RELEVANT RESIDUES IN SEQ ID NO: (1)..(1555)
tttatggagagtttgatcctggctcaggatgaacgctggcggcgtgcctaatacatgcaagtcgagcgaacggataaggagcttgctcctttgaagttagcggcggacgggtgagtaacacgtgggtaacctacctataagactggaataacttcgggaaaccggagctaatgccggataacatttggaaccgcatggttctaaagtaaaagatggttttgctatcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatggacgaaagtctgacggagcaacgccgcgtgagtgatgaaggttttcggatcgtaaaactctgttattagggaagaacaaatgtgtaagtaactgtgcacatcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtacagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaaaactctagagatagagccttccccttcgggggacaaagtgacaggtggtgcatggttgtcgtcagctcgtgtcgtgagatgttgggttaagtcccgcaacgagcgcaacccttaaacttagttgccagcatttagttgggcactctaggttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaaggtagccgtatcggaaggtgcggctggatcacctcctttct

SEQ ID NO: 8791 - DNA, 1551 bp, Staphylococcus felis
  ref <308>: DATABASE ACCESSION NUMBER: NCBI ACCESSION: NZ_QKYJ01000053.1
  ref <309>: DATABASE ENTRY DATE: 2019-04-01
  ref <313>: RELEVANT RESIDUES IN SEQ ID NO: (1)..(1551)
tatggagagtttgatcctggctcaggatgaacgctggcggcgtgcctaatacatgcaagtcgagcgaactgaagaggagcttgctcctttgacgttagcggcggacgggtgagtaacacgtgggtaacctacctataagactggaataactccgggaaaccggggctaatgccggataatatattgaaccgcatggttcaacagtgaaagacggttttgctgtcacttatagatggacccgcgtcgcattagctagttggtgaggtaacggcttaccaaggcgacgatgcgtagccgacctgagagggtgatcggccacactggaactgagacacggtccagactcctacgggaggcagcagtagggaatcttccgcaatggacgaaagtctgacggagcaacgccgcgtgagtgatgaaggtcttcggatcgtaaagctctgttgttagggaagaacaaatgtgtaagtaactgtgcacatcttgacggtacctaaccagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcggctttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcctttgaccgctctagagatagagttttcctcttcggaggacaaagtgacaggtggtgcatggttgtcgtcagctcgtgtcgtgagatgttgggttaagtcccgcaacgagcgcaacccttaagcttagttgccatcattaagttgggcactctaggctgactgccggtgacaaaccggaggaaggtggggatgacgtcaaatcatcatgccccttatgatttgggctacacacgtgctacaatggacaatacaaagggcagcgaaaccgtgaggtcaagccaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttct

SEQ ID NO: 8792 - DNA, 1557 bp, Staphylococcus fleurettii
  ref <308>: DATABASE ACCESSION NUMBER: NCBI ACCESSION: NZ_UHDL01000001.1
  ref <309>: DATABASE ENTRY DATE: 2019-04-01
  ref <313>: RELEVANT RESIDUES IN SEQ ID NO: (1)..(1557)
ttatggagagtttgatcctggctcaggatgaacgctggcggcgtgcctaatacatgcaagtcgagcgaacagatgagaagcttgcttctctgatgttagcggcggacgggtgagtaacacgtgggtaacctacctataagactgggataactccgggaaaccggggctaatacctgataatattttgaaccgcatggttcgatagtgaaaggcggcttcggctgtcacttatagatggacccgcgccgtattagctagttggtaaggtaatggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggttttcggatcgtaaaactctgttgttagggaagaacaaatttgttagtaactgaacaagtcttgacggtacctaaccagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactggggaacttgagtgcagaagaggagagtggaattccatgtgtagcggtgaaatgcgcagagatatggaggaacaccagtggcgaaggcggctctctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgatcgctctagagatagagtcttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacacgtgctacaatggataatacaaagggcagcgaacccgcgaggtcaagcaaatcccataaaattattctcagttcggattgtagtctgcaactcgactacatgaagctggaatcgctagtaatcgtagatcagcatgctacggtgaatacgttcccgggtcttgtacacaccgcccgtcacaccacgagagtctgtaacacccgaagccggtggagtaaccttttattaggagctagccgtcgaaggtgggacaaatgattggggtgaagtcgtaacaaggtagccgtatcggaaggtgcggctggatcacctcctttct

SEQ ID NO: 8793 - DNA, 1553 bp, Staphylococcus haemolyticus
  ref <308>: DATABASE ACCESSION NUMBER: NCBI ACCESSION: NZ_UHDN01000001.1
  ref <309>: DATABASE ENTRY DATE: 2019-04-01
  ref <313>: RELEVANT RESIDUES IN SEQ ID NO: (1)..(1553)
tttatggagagtttgatcctggctcaggatgaacgctggcggcgtgcctaatacatgcaagtcgagcgaacagacaaggagcttgctcctttgacgttagcggcggacgggtgagtaacacgtgggtaacctacctataagactgggataacttcgggaaaccggagctaataccggataatatttcgaaccgcatggttcgatagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatacgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttct

SEQ ID NO: 8794 - DNA, 1553 bp, Staphylococcus hominis
  ref <308>: DATABASE ACCESSION NUMBER: NCBI ACCESSION: NZ_UHDM01000002.1
  ref <309>: DATABASE ENTRY DATE: 2019-04-01
  ref <313>: RELEVANT RESIDUES IN SEQ ID NO: (1)..(1553)
tttatggagagtttgatcctggctcaggatgaacgctggcggcgtgcctaatacatgcaagtcgagcgaacagacgaggagcttgctcctttgacgttagcggcggacgggtgagtaacacgtgggtaacctacctataagactgggataacttcgggaaaccggagctaataccggataatatttcgaaccgcatggttcgatagtgaaagatggctttgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagttggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttct

SEQ ID NO: 8795 - DNA, 1553 bp, Staphylococcus hyicus
  ref <308>: DATABASE ACCESSION NUMBER: NCBI ACCESSION: NZ_LR134264.1
  ref <309>: DATABASE ENTRY DATE: 2019-04-01
  ref <313>: RELEVANT RESIDUES IN SEQ ID NO: (1)..(1553)
ttatggagagtttgatcctggctcaggatgaacgctggcggcgtgcctaatacatgcaagtcgagcgaacagacgaggagcttgctcctctgacgttagcggcggacgggtgagtaacacgtgggtaacctacctataagactgggataactccgggaaaccggggctaataccggataacacatgaaaccgcatggtttcatgatgaaagacggttttgctgtcacttatagatggacccgcggcgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaagggtgtaagtaactatgcaccccttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcggctttctggtctgcaactgacgctgatgtgcgaaagcgtggggatcaaacaggattagataccctggtagtccacgccgtaaacgatgagtgctaagtgttaggggggttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacggtacaaagggcagcgaacccgcgaggtcaagcaaatcccataaagccgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggaactagccgtcgaaggtgggacaaatgattggggtgaagtcgtaacaaggtagccgtatcggaaggtgcggctggatcacctcctttct

SEQ ID NO: 8796 - DNA, 1554 bp, Staphylococcus intermedius
  ref <308>: DATABASE ACCESSION NUMBER: NCBI ACCESSION: NZ_UHDP01000003.1
  ref <309>: DATABASE ENTRY DATE: 2019-04-01
  ref <313>: RELEVANT RESIDUES IN SEQ ID NO: (1)..(1554)
tttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactggaataactccgggaaaccggggctaatgccagataacatgttgaaccgcatggttctacagtgaaagacggtcttgctgtcacttatagatggacccgcgccgtattagctagttggtggggtaacggcctaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaagctctgttgttagggaagaacaaatgtgtaagtaactgtgcacatcttgacggtacctaaccagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcggctttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcctttgaccgctctagagatagagttttcctcttcggaggacaaagtgacaggtggtgcatggttgtcgtcagctcgtgtcgtgagatgttgggttaagtcccgcaacgagcgcaacccttgaacttagttgccatcattcagttgggcactctaagttgactgccggtgacaaaccggaggaaggtggggatgacgtcaaatcatcatgccccttatgatttgggctacacacgtgctacaatggacaatacaaagggcagcaaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccattttggagctagccgtcgaaggtgggacaaatgattggggtgaagtcgtaacaaggtagccgtatcggaaggtgcggctggatcacctcctttct

SEQ ID NO: 8797 - DNA, 1554 bp, Staphylococcus kloosii
  ref <308>: DATABASE ACCESSION NUMBER: NCBI ACCESSION: NZ_UHDQ01000002.1
  ref <309>: DATABASE ENTRY DATE: 2019-04-01
  ref <313>: RELEVANT RESIDUES IN SEQ ID NO: (1)..(1554)
tttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactggaataacttcgggaaaccgaagctaatgccggataacatgtagaaccgcatggttctacagtgaaagatggccttgctatcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaagctctgttattagggaagaacaagtgcgtaagtaactgtgcgcaccttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggagacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccactctggagacagagctttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccattatggagctagccgtcgaaggtgggacaaatgattggggtgaagtcgtaacaaggtagccgtatcggaaggtgcggctggatcacctcctttct

SEQ ID NO: 8798 - DNA, 1558 bp, Staphylococcus lentus
  ref <308>: DATABASE ACCESSION NUMBER: NCBI ACCESSION: NZ_UHDR01000002.1
  ref <309>: DATABASE ENTRY DATE: 2019-04-01
  ref <313>: RELEVANT RESIDUES IN SEQ ID NO: (1)..(1558)
tttatggagagtttgatcctggctcaggatgaacgctggcggcgtgcctaatacatgcaagtcgagcgaacagatgagaagcttgcttctctgatgttagcggcggacgggtgagtaacacgtgggtaacctacctataagactgggataactccgggaaaccggggctaataccggataatatattgaaccgcatggttcaatgttgaaagacggtttcggctgtcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttaggatcgtaaaactctgttgttagggaagaacaaatttgttagtaactgaacaagtcttgacggtacctaaccagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactggggaacttgagtgcagaagaggagagtggaattccatgtgtagcggtgaaatgcgcagagatatggaggaacaccagtggcgaaggcggctctctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgatcgctctagagatagagttttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacacgtgctacaatggataatacaaagggtagcgaacccgcgaggtcaagcaaatcccataaaattattctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttattaggagctagccgtcgaaggtgggacagatgattggggtgaagtcgtaacaaggtagccgtatcggaaggtgcggctggatcacctcctttct

SEQ ID NO: 8799 - DNA, 1553 bp, Staphylococcus lugdunensis
  ref <308>: DATABASE ACCESSION NUMBER: NCBI ACCESSION: NZ_LS483482.1
  ref <309>: DATABASE ENTRY DATE: 2019-04-01
  ref <313>: RELEVANT RESIDUES IN SEQ ID NO: (1)..(1553)
tttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactgggacaacttcgggaaaccggagctaataccggataatatgttgaaccgcatggttcaatagtgaaagatggttttgctatcacttatagatggacccgcgccgtattagctagttggtgaggtaacggctcaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttaggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagtctttcccttcgggggacaaagtgacaggtggtgcatggttgtcgtcagctcgtgtcgtgagatgttgggttaagtcccgcaacgagcgcaacccttaagcttagttgccatcatttagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttct

SEQ ID NO: 8800 - DNA, 1248 bp, Staphylococcus lutrae
  ref <308>: DATABASE ACCESSION NUMBER: NCBI ACCESSION: NZ_PPRH01000036.1
  ref <309>: DATABASE ENTRY DATE: 2019-04-01
  ref <313>: RELEVANT RESIDUES IN SEQ ID NO: (1)..(1248)
gatcggccacactggaactgagacacggtccagactcctacgggaggcagcagtagggaatcttccgcaatgggcgaaagcctgacggagcaacgccgcgtgagtgatgaaggtcttcggatcgtaaagctctgttgttagggaagaacacatgtgtaagtcactatgcacatcttgacggtacctaaccagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcggctttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcctttgaccgctctagagatagagttttcctcttcggaggacaaagtgacaggtggtgcatggttgtcgtcagctcgtgtcgtgagatgttgggttaagtcccgcaacgagcgcaacccttgaacttagttgccatcattcagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccattttggagctagccgtcgaaggtgggacaaatgattggggtgaagtcgtaacaaggtagccgtatcggaaggtgcggctggatcacctcctttctaagga

SEQ ID NO: 8801 - DNA, 1139 bp, Staphylococcus massiliensis
  ref <308>: DATABASE ACCESSION NUMBER: NCBI ACCESSION: NZ_PPRO01000039.1
  ref <309>: DATABASE ENTRY DATE: 2019-04-01
  ref <313>: RELEVANT RESIDUES IN SEQ ID NO: (1)..(1139)
acctataagactggaataactccgggaaaccggggctaatgccggatgacatgttgaaccgcatggttcaacattgaaaggcggttttgctgtcacttatagatggacctgcgccgtattagctagttggtaaggtaatggcttaccaaggcgacgatacgtagccgacctgagagggtgatcggccacactggaactgagacacggtccagactcctacgggaggcagcagtagggaatcttccgcaatggacgaaagtctgacggagcaacgccgcgtgagtgatgaaggttttcggatcgtaaagctctgttattagggaagaacaagtgcgtaggtaactatgcgcaccttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggatggtcattggaaactggggaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgatcgcaagattgaaactcaaaggaattgacggggacccgcacaagcggtggagcatgtggtttaattcgaagcaacgcgaagaaccttaccaaatcttgacatcctttgaccgctctagagatagagttttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacggtacaaagggtcgctaa

SEQ ID NO: 8802 - DNA, 1553 bp, Staphylococcus microti
  ref <308>: DATABASE ACCESSION NUMBER: NCBI ACCESSION: NZ_UHDT01000001.1
  ref <309>: DATABASE ENTRY DATE: 2019-04-01
  ref <313>: RELEVANT RESIDUES IN SEQ ID NO: (1)..(1553)
tttatggagagtttgatcctggctcaggatgaacgctggcggcgtgcctaatacatgcaagtcgagcgaacagacgaggtgcttgcacctctgacgttagcggcggacgggtgagtaacacgtgggtaacctacctataagactgggataactccgggaaaccggggctaataccggataacatattgaaccgcatggttcaatagtgaaagacggttttgctgtcacttatagatggacccgcgccgtattagctagttggtgaggtaacggctcaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaagctctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcggctttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcctttgaccgcactagagatagtgttttcctcttcggaggacaaagtgacaggtggtgcatggttgtcgtcagctcgtgtcgtgagatgttgggttaagtcccgcaacgagcgcaacccttgagcttagttgccatcattaagttgggcactctaagctgactgccggtgacaaaccggaggaaggtggggatgacgtcaaatcatcatgccccttatgatttgggctacacacgtgctacaatggacattacaaagggcagcaaaaccgcgaggtcaagcaaatcccataaagatgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttct

SEQ ID NO: 8803 - DNA, 1556 bp, Staphylococcus muscae
  ref <308>: DATABASE ACCESSION NUMBER: NCBI ACCESSION: NZ_LT906464.1
  ref <309>: DATABASE ENTRY DATE: 2019-04-01
  ref <313>: RELEVANT RESIDUES IN SEQ ID NO: (1)..(1556)
ttttatggagagtttgatcctggctcaggatgaacgctggcggcgtgcctaatacatgcaagtcgagcgaacagacgaggtgcttgcacctctgacgttagcggcggacgggtgagtaacacgtgggtaacctacctataaaactggaataacttcgggaaaccggagctaatgccggataatatattgaaccgcatggttcaatagtgaaagacggttttgctgtcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaagctctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcggctttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcctttgaccgcactagagatagtgttttcctcttcggaggacaaagtgacaggtggtgcatggttgtcgtcagctcgtgtcgtgagatgttgggttaagtcccgcaacgagcgcaacccttgagcttagttgccatcattaagttgggcactctaagttgactgccggtgacaaaccggaggaaggtggggatgacgtcaaatcatcatgccccttatgatttgggctacacacgtgctacaatggacattacaaagggcagcgaaaccgcgaggtcaagcaaatcccataaagatgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8804 - DNA, 1555 bp, Staphylococcus nepalensis
  ref <308>: DATABASE ACCESSION NUMBER: NCBI ACCESSION: NZ_UHDS01000001.1
  ref <309>: DATABASE ENTRY DATE: 2019-04-01
  ref <313>: RELEVANT RESIDUES IN SEQ ID NO: (1)..(1555)
tttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactggaataactccgggaaaccggggctaatgccggataatatttagaaccgcatggttctaaagtgaaagatggttttgctatcacttatagatggacccgcgccgtattagctagttggtggggtaatggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagtcttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtctgtaacacccgaagccggtggagtaaccatttatggagctagccgtcgaaggtgggacaaatgattggggtgaagtcgtaacaaggtagccgtatcggaaggtgcggctggatcacctcctttct

SEQ ID NO: 8805 - DNA, 236 bp, Staphylococcus pasteuri
  ref <308>: DATABASE ACCESSION NUMBER: NCBI ACCESSION: NZ_FPKT01000009.1
  ref <309>: DATABASE ENTRY DATE: 2019-04-01
  ref <313>: RELEVANT RESIDUES IN SEQ ID NO: (1)..(236)
ttttatggagagtttgatcctggctcaggatgaacgctggcggcgtgcctaatacatgcaagtcgagcgaacagataaggagcttgctcctttgacgttagcggcggacgggtgagtaacacgtggataacctacctataagactgggataacttcgggaaaccggagctaataccggataagattttgaaccgcatggttcaatagtgaaagacggccttgctgtcacttataga

SEQ ID NO: 8806 - DNA, 1030 bp, Staphylococcus pasteuri
tttatggagagtttgatcctggctcaggatgaacgctggcggcgtgcctaatacatgcaagtcgagcgaacagataaggagcttgctcctttgacgttagcggcggacgggtgagtaacacgtggataacctacctataagactgggataacttcgggaaaccggagctaataccggataacatattgaaccgcatggttcaatagtgaaaggcggctttgctgtcacttatagatggatccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttatcagggaagaacaaatgtgtaagtaactgtgcacatcttgacggtacctgatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagt

SEQ ID NO: 8807 - DNA, 1553 bp, Staphylococcus petrasii
  ref <308>: DATABASE ACCESSION NUMBER: NCBI ACCESSION: NZ_UHDO01000001.1
  ref <309>: DATABASE ENTRY DATE: 2019-04-01
  ref <313>: RELEVANT RESIDUES IN SEQ ID NO: (1)..(1553)
tttatggagagtttgatcctggctcaggatgaacgctggcggcgtgcctaatacatgcaagtcgagcgaacagacgaggagcttgctcctctgacgttagcggcggacgggtgagtaacacgtgggtaacctacctataagactgggataacttcgggaaaccggagctaataccggataatattttgaaccgcatggttcaaaagtgaaagatggctctgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttct

SEQ ID NO: 8808 - DNA, 1557 bp, Staphylococcus pettenkoferi
  ref <308>: DATABASE ACCESSION NUMBER: NCBI ACCESSION: NZ_NWTY01000059.1
  ref <309>: DATABASE ENTRY DATE: 2019-04-01
  ref <313>: RELEVANT RESIDUES IN SEQ ID NO: (1)..(1557)
tttatggagagtttgatcctggctcaggatgaacgctggcggcgtgcctaatacatgcaagtcgagcgaacagacggggagcttgctcccccgacgttagcggcggacgggtgagtaacacgtgggtaacctacctataagactggaataactccgggaaaccggggctaatgccggataacatgtgtggaccgcatggtcctacagtgaaagacggtcttgctgtcacttatagatggacccgcgccgtattagctagttggtaaggtaacggcttaccaaggcaacgatacgtagccgacctgagagggtgatctgccacactggaactgagacccggtccagactcctacgggaggcagcagtcgggaatcttccgccatgggcgaaagcctgacggagcaacgccgcgcgcgtgatgaaggccttcgggtcgtaaaactctgttattagggaagaacaaatgcgtaagtaactatgcacgtcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcaggagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgccccctctagagatagcggtttccccttcgggggacaaagtgacaggtggtgcatggttgtcgtcagctcgtgtcgtgagatgttgggttaagtcccgcaacgagcgcaacccttaagcttagttgccatcattcagttgggcactctaagttgactgccggtgataaaccggaggaaggtggggatgacgtcaaatcatcatgccccttatgatttgggctacacacgtgctacaatggacaatacaaagggcagctaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagcaaccactttgtggagctagccgtcgaaggtgggacaaatgattggggtgaagtcgtaacaaggtagccgtatcggaaggtgcggctggatcacctcctttct

SEQ ID NO: 8809 - DNA, 1557 bp, Staphylococcus piscifermentans
  ref <308>: DATABASE ACCESSION NUMBER: NCBI ACCESSION: NZ_LT906447.1
  ref <309>: DATABASE ENTRY DATE: 2019-04-01
  ref <313>: RELEVANT RESIDUES IN SEQ ID NO: (1)..(1557)
ttttatggagagtttgatcctggctcaggatgaacgctggcggcgtgcctaatacatgcaagtcgagcgaacagacgaggagcttgctcctctgacgttagcggcggacgggtgagtaacacgtgggtaacctacctataagactggaataactccgggaaaccggggctaatgccggataatatgcggaaccgcatggttccgcaatgaaagacggttttgctgtcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaagtgcgtaggtaactatgcgcaccttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacagtacaaagggcagcgaaaccgcgaggtcaagcaaatcccataaagctgttctcagttcggattgtagtctgcaactcgactacatgaagctggaatcgctagtaatcgtagatcagcatgctacggtgaatacgttcccgggtcttgtacacaccgcccgtcacaccacgagagttcgtaacacccgaagccggtggagtaaccttttaggagctagccgtcgaaggtgggacgaatgattggggtgaagtcgtaacaaggtagccgtatcggaaggtgcggctggatcacctcctttctaa

SEQ ID NO: 8810 - DNA, 1554 bp, Staphylococcus pseudintermedius
  ref <308>: DATABASE ACCESSION NUMBER: NCBI ACCESSION: NZ_QHJC01000042.1
  ref <309>: DATABASE ENTRY DATE: 2019-04-01
  ref <313>: RELEVANT RESIDUES IN SEQ ID NO: (1)..(1554)
tttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactggaataactccgggaaaccggggctaatgccggataacatgttgaaccgcatggttctacagtgaaagacggtcttgctgtcacttatagatggacccgcgccgtattagctagttggtggggtaacggcctaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaagctctgttgttagggaagaacaaatgtgtaagtaactgtgcacatcttgacggtacctaaccagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcggctttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcctttgaccgctctagagatagagttttcctcttcggaggacaaagtgacaggtggtgcatggttgtcgtcagctcgtgtcgtgagatgttgggttaagtcccgcaacgagcgcaacccttgaacttagttgccatcattcagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccattttggagctagccgtcgaaggtgggacaaatgattggggtgaagtcgtaacaaggtagccgtatcggaaggtgcggctggatcacctcctttct

SEQ ID NO: 8811 - DNA, 1549 bp, Staphylococcus rostri
  ref <308>: DATABASE ACCESSION NUMBER: NCBI ACCESSION: NZ_PPRF01000046.1
  ref <309>: DATABASE ENTRY DATE: 2019-04-01
  ref <313>: RELEVANT RESIDUES IN SEQ ID NO: (1)..(1549)
tggagagtttgatcctggctcaggatgaacgctggcggcgtgcctaatacatgcaagtcgagcgaacagacgaggtgcttgcacctctgacgttagcggcggacgggtgagtaacacgtgggtaacctacctataagactggaataactccgggaaaccggggctaatgccggataacatattgaaccgcatggttcaatagtgaaagacggtcttgctgtcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaagctctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcggctttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcctttgaccgcactagagatagtgttttcctcttcggaggacaaagtgacaggtggtgcatggttgtcgtcagctcgtgtcgtgagatgttgggttaagtcccgcaacgagcgcaacccttgagcttagttgccatcattaagttgggcactctaagctgactgccggtgacaaaccggaggaaggtggggatgacgtcaaatcatcatgccccttatgatttgggctacacacgtgctacaatggacattacaaagggcagcaaaaccgcgaggtcaagcaaatcccataaagatgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttct

SEQ ID NO: 8812 - DNA, 1553 bp, Staphylococcus saccharolyticus
  ref <308>: DATABASE ACCESSION NUMBER: NCBI ACCESSION: NZ_UHDZ01000001.1
  ref <309>: DATABASE ENTRY DATE: 2019-04-01
  ref <313>: RELEVANT RESIDUES IN SEQ ID NO: (1)..(1553)
tttatggagagtttgatcctggctcaggatgaacgctggcggcgtgcctaatacatgcaagtcgagcgaacagacgaggagcttgctcctctgacgttagcggcggacgggtgagtaacacgtggataacctacctataagactgggataacttcgggaaaccggagctaataccagataacatgttgaaccgcatggttcaacagtgaaagacggtcttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaaccccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaaccttttggagctagccgtcgaaggtgggacaaatgattggggtgaagtcgtaacaaggtagccgtatcggaaggtgcggctggatcacctcctttct

SEQ ID NO: 8813 - DNA, 1555 bp, Staphylococcus saprophyticus; identical to SEQ ID NO: 8788
  ref <308>: DATABASE ACCESSION NUMBER: NCBI ACCESSION: NZ_LR134089.1
  ref <309>: DATABASE ENTRY DATE: 2019-04-01
  ref <313>: RELEVANT RESIDUES IN SEQ ID NO: (1)..(1555)

SEQ ID NO: 8814 - DNA, 1555 bp, Staphylococcus saprophyticus subsp. saprophyticus
tttatggagagtttgatcctggctcaggatgaacgctggcggcgtgcctaatacatgcaagtcgagcgaacagataaggagcttgctcctttgacgttagcggcggacgggtgagtaacacgtggataacctacctataagactgggataacttcgggaaaccggagctaataccggataacatattgaaccgcatggttcaatagtgaaaggcggctttgctgtcacttatagatggatccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttatcagggaagaacaaatgtgtaagtaactgtgcacatcttgacggtacctgatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagctaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaaggtagccgtatcggaaggtgcggctggatcacctcctttct

SEQ ID NO: 8815 - DNA, 1554 bp, Staphylococcus schleiferi
  ref <308>: DATABASE ACCESSION NUMBER: NCBI ACCESSION: NZ_CP035007.1
  ref <309>: DATABASE ENTRY DATE: 2019-04-01
  ref <313>: RELEVANT RESIDUES IN SEQ ID NO: (1)..(1554)
tttatggagagtttgatcctggctcaggatgaacgctggcggcgtgcctaatacatgcaagtcgagcgaacggacaaggagcttgctcctttgaagttagcggcggacgggtgagtaacacgtgggtaacctacctataagactggaataactccgggaaaccggggctaatgccggataacatgttgaaccgcatggttcaacagtgaaagacggtcttgctgtcacttatagatggacccgcgccgtattagctagttggtggggtaacggcctaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaagctctgttgttagggaagaacaaatgtgtaagtaactgtgcacgtcttgacggtacctaaccagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcggctttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcctttgaccgctctagagatagagttttcctcttcggaggacaaagtgacaggtggtgcatggttgtcgtcagctcgtgtcgtgagatgttgggttaagtcccgcaacgagcgcaacccttgagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccattttggagctagccgtcgaaggtgggacaaatgattggggtgaagtcgtaacaaggtagccgtatcggaaggtgcggctggatcacctcctttct

SEQ ID NO: 8816 - DNA, 1554 bp, Staphylococcus schweitzeri
  ref <308>: DATABASE ACCESSION NUMBER: NCBI ACCESSION: NZ_LR134304.1
  ref <309>: DATABASE ENTRY DATE: 2019-04-01
  ref <313>: RELEVANT RESIDUES IN SEQ ID NO: (1)..(1554)
tttatggagagtttgatcctggctcaggatgaacgctggcggcgtgcctaatacatgcaagtcgagcgaacggacgagaagcttgcttctctgatgttagcggcggacgggtgagtaacacgtggataacctacctataagactgggataacttcgggaaaccggagctaataccggataatattttgaaccgcatggttcaaaagtgaaagacggtcttgctgtcacttatagatggatccgcgctgcattagctagttggtaaggtaacggcttaccaaggcaacgatgcatagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatatgtgtaagtaactgtgcacatcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagccaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacaaatgattggggtgaagtcgtaacaaggtagccgtatcggaaggtgcggctggatcacctcctttct

SEQ ID NO: 8817 - DNA, 1560 bp, Staphylococcus sciuri
  ref <308>: DATABASE ACCESSION NUMBER: NCBI ACCESSION: NZ_LS483305.1
  ref <309>: DATABASE ENTRY DATE: 2019-04-01
  ref <313>: RELEVANT RESIDUES IN SEQ ID NO: (1)..(1560)
tttatggagagtttgatcctggctcaggatgaacgctggcggcgtgcctaatacatgcaagtcgagcgaacagatgagaagcttgcttctctgatgttagcggcggacgggtgagtaacacgtgggtaacctacctataagactgggataactccgggaaaccggggctaataccggataatattttgaaccgcatggttcaatagtgaaagacggtttcggctgtcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttgttagggaagaacaaatttgttagtaactgaacaagtcttgacggtacctaaccagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactggggaacttgagtgcagaagaggagagtggaattccatgtgtagcggtgaaatgcgcagagatatggaggaacaccagtggcgaaggcggctctctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacacgtgctacaatggataatacaaagggcagcgaatccgcgaggccaagcaaatcccataaaattattctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacaaatgattggggtgaagtcgtaacaaggtagccgtatcggaaggtgcggctggatcacctcctttctaagga

SEQ ID NO: 8818 - DNA, 1558 bp, Staphylococcus simiae
  ref <308>: DATABASE ACCESSION NUMBER: NCBI ACCESSION: NZ_LT906460.1
  ref <309>: DATABASE ENTRY DATE: 2019-04-01
  ref <313>: RELEVANT RESIDUES IN SEQ ID NO: (1)..(1558)
attttatggagagtttgatcctggctcaggatgaacgctggcggcgtgcctaatacatgcaagtcgagcgaacagatgagaagtttgcttctctgatgttagcggcggacgggtgagtaacacgtggataacctacctataagactgggataacttcgggaaaccggagctaataccggataatatatcgaaccgcatggttcaatagtgaaagatggtcttgctatcacttatagatggatccgcgctgcattagctagttggtaaggtaacggcttaccaaggcaacgatgcatagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatatgtgtaagtaactgtgcacatcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacaaatgattggggtgaagtcgtaacaaggtagccgtatcggaaggtgcggctggatcacctcctttctaa

SEQ ID NO: 8819 - DNA, 1554 bp, Staphylococcus simulans
  ref <308>: DATABASE ACCESSION NUMBER: NCBI ACCESSION: NZ_LS483313.1
  ref <309>: DATABASE ENTRY DATE: 2019-04-01
  ref <313>: RELEVANT RESIDUES IN SEQ ID NO: (1)..(1554)
ttatggagagtttgatcctggctcaggatgaacgctggcggcgtgcctaatacatgcaagtcgagcgaacagacgaggagcttgctcctctgacgttagcggcggacgggtgagtaacacgtgggtaacctacctataagactgggataactccgggaaaccggggctaataccggataacacatgaaaccgcatggtttcatgatgaaagacggttttgctgtcacttatagatggacccgcggcgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaagggtgtaagtaactatgcaccccttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctttgacaactctagagatagagccttccccttcgggggataaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacggtacaaagggcagcgaacccgcgaggtcaagcaaatcccataaagccgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggaactagccgtcgaaggtgggacaaatgattggggtgaagtcgtaacaaggtagccgtatcggaaggtgcggctggatcacctcctttcta

SEQ ID NO: 8820 - DNA, 1558 bp, Staphylococcus sp. 47.1
  ref <308>: DATABASE ACCESSION NUMBER: NCBI ACCESSION: NZ_MSFG01000034.1
  ref <309>: DATABASE ENTRY DATE: 2019-04-01
  ref <313>: RELEVANT RESIDUES IN SEQ ID NO: (1)..(1558)
ttttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactggaataactccgggaaaccggggctaatgccggataacatttagaaccgcatggttctaaagtgaaagatggttttgctatcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaaggtagccgtatcggaaggtgcggctggatcacctcctttctaa

SEQ ID NO: 8821 - DNA, 1560 bp, Staphylococcus sp. AntiMn-1
  ref <308>: DATABASE ACCESSION NUMBER: NCBI ACCESSION: NZ_CP012968.1
  ref <309>: DATABASE ENTRY DATE: 2019-04-01
  ref <313>: RELEVANT RESIDUES IN SEQ ID NO: (1)..(1560)
tttatggagagtttgatcctggctcaggatgaacgctggcggcgtgcctaatacatgcaagtcgagcgaacggataaggagcttgctcctttgaagttagcggcggacgggtgagtaacacgtgggtaacctacctataagactggaataacttcgggaaaccggagctaatgccggataacatttggaaccgcatggttctaaagtaaaagatggttttgctatcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatggacgaaagtctgacggagcaacgccgcgtgagtgatgaaggttttcggatcgtaaaactctgttattagggaagaacaaatgtgtaagtaactgtgcacatcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtacagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaaaactctagagatagagccttccccttcgggggacaaagtgacaggtggtgcatggttgtcgtcagctcgtgtcgtgagatgttgggttaagtcccgcaacgagcgcaacccttaaacttagttgccagcatttagttgggcactctaggttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaaggtagccgtatcggaaggtgcggctggatcacctcctttctaagga

SEQ ID NO: 8822 - DNA, 1553 bp, Staphylococcus sp. AtHG25
  ref <308>: DATABASE ACCESSION NUMBER: NCBI ACCESSION: NZ_QJSN01000035.1
  ref <309>: DATABASE ENTRY DATE: 2019-04-01
  ref <313>: RELEVANT RESIDUES IN SEQ ID NO: (1)..(1553)
tttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactgggataacttcgggaaaccggagctaataccggataatatttcgaaccgcatggttcgatagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttct

SEQ ID NO: 8823 - DNA, 1287 bp, Staphylococcus sp. E463
  ref <308>: DATABASE ACCESSION NUMBER: NCBI ACCESSION: NZ_ANBY01000113.1
  ref <309>: DATABASE ENTRY DATE: 2019-04-01
  ref <313>: RELEVANT RESIDUES IN SEQ ID NO: (1)..(1287)
ttttatggagagtttgatcctggctcaggatgaacgctggcggcgtgcctaatacatgcaagtcgagcgaacagataaggagcttgctcctttgacgttagcggcggacgggtgagtaacacgtggataacctacctataagactgggataacttcgggaaaccggagctaataccggataagattttgaaccgcatggttcaatagtgaaagacggccttgctgtcacttatagatggatccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttatcagggaagaacaaacgtgtaagtaactgtgcacgtcttgacggtacctgatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagttttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagctaaaccgcgaggtcaagc

SEQ ID NO: 8824 - DNA, 1428 bp, Staphylococcus sp. EGD-HP3
  ref <308>: DATABASE ACCESSION NUMBER: NCBI ACCESSION: NZ_AVOQ01000031.1
  ref <309>: DATABASE ENTRY DATE: 2019-04-01
  ref <313>: RELEVANT RESIDUES IN SEQ ID NO: (1)..(1428)
acctataagactggaataactccgggaaaccggggctaatgccggataacatttagaaccgcatggttctaaagtgaaagatggttttgctatcacttatagatggacccgcgccgtattagctagttggtaaggtaatggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaagggtttcggctcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggagacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccactctagagatagagctttccccttcgggggacaaagtgacaggtggtgcatggttgtcgtcagctcgtgtcgtgagatgttgggttaagtcccgcaacgagcgcaacccttaaacttagttgccagcatttagttgggcactctaggttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaaggtagccgtatcggaaggtgcggctggatcacctcctttctaagga

SEQ ID NO: 8825 - DNA, 1555 bp, Staphylococcus sp. EZ-P03
  ref <308>: DATABASE ACCESSION NUMBER: NCBI ACCESSION: NZ_QPMO01000050.1
  ref <309>: DATABASE ENTRY DATE: 2019-04-01
  ref <313>: RELEVANT RESIDUES IN SEQ ID NO: (1)..(1555)
tttatggagagtttgatcctggctcaggatgaacgctggcggcgtgcctaatacatgcaagtcgagcgaacagacgaggagcttgctcctctgacgttagcggcggacgggtgagtaacacgtgggtaacctacctataagactggaataactccgggaaaccggggctaatgccggataatacatgaaaccgcatggtttcatgatgaaagacggtcttgctgtcacttatagatggacccgcggcgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaggatgtaagtaactgtgcatcccttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaaccttaccaaatcttgacatcctttgacaactctggagacagagccttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacggtacaaagggcagcgaacccgcgaggtcaagcaaatcccataaagccgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggaactagccgtcgaaggtgggacaaatgattggggtgaagtcgtaacaaggtagccgtatcggaaggtgcggctggatcacctcctttct

SEQ ID NO: 8826 - DNA, 1555 bp, Staphylococcus sp. FDAARGOS 39; identical to SEQ ID NO: 8814
  ref <308>: DATABASE ACCESSION NUMBER: NCBI ACCESSION: NZ_JYAQ02000004.1
  ref <309>: DATABASE ENTRY DATE: 2019-04-01
  ref <313>: RELEVANT RESIDUES IN SEQ ID NO: (1)..(1555)

SEQ ID NO: 8827 - DNA, 1557 bp, Staphylococcus sp. HGB0015
  ref <308>: DATABASE ACCESSION NUMBER: NCBI ACCESSION: NZ_KE150417.1
  ref <309>: DATABASE ENTRY DATE: 2019-04-01
  ref <313>: RELEVANT RESIDUES IN SEQ ID NO: (1)..(1557)
ttttatggagagtttgatcctggctcaggatgaacgctggcggcgtgcctaatacatgcaagtcgagcgaacggacgaggagcttgctcctttgaagttagcggcggacgggtgagtaacacgtgggtaacctacctataagactggaataactccgggaaaccggggctaatgccggataacatgttgaaccgcatggttcaacagtgaaagacggtcttgctgtcacttatagatggacccgcgccgtattagctagttggtggggtaacggcctaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaagctctgttgttagggaagaacaaatgtgtaagtaactgtgcacgtcttgacggtacctaaccagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcggctttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacggggacccgcacaagcggtggagcatgtggtttaattcgaagcaacgcgaagaaccttaccaaatcttgacatcctttgaccgctctagagatagagttttcctcttcggaggacaaagtgacaggtggtgcatggttgtcgtcagctcgtgtcgtgagatgttgggttaagtcccgcaacgagcgcaacccttgagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacactcgaagccggtggagtaaccattttggagctagccgtcgaaggtgggacaaatgattggggtgaagtcgtaacaaggtagccgtatcggaaggtgcggctggatcacctcctttctaa

SEQ ID NO: 8828 - DNA, 963 bp, Staphylococcus sp. HMSC034A07
  ref <308>: DATABASE ACCESSION NUMBER: NCBI ACCESSION: NZ_KV825650.1
  ref <309>: DATABASE ENTRY DATE: 2019-04-01
  ref <313>: RELEVANT RESIDUES IN SEQ ID NO: (1)..(963)
ttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaagga

SEQ ID NO: 8829 - DNA, 1556 bp, Staphylococcus sp. HMSC034C12
  ref <308>: DATABASE ACCESSION NUMBER: NCBI ACCESSION: NZ_KV826343.1
  ref <309>: DATABASE ENTRY DATE: 2019-04-01
  ref <313>: RELEVANT RESIDUES IN SEQ ID NO: (1)..(1556)
ttttatggagagtttgatcctggctcaggatgaacgctggcggcgtgcctaatacatgcaagtcgagcgaacagacgaggagcttgctcctttgacgttagcggcggacgggtgagtaacacgtaggtaacctacctataagactgggataacttcgggaaaccggagctaataccggataatatttcgaaccgcatggttcgatagtgaaagatggctttgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8830 - DNA, 1556 bp, Staphylococcus sp. HMSC034D07
  ref <308>: DATABASE ACCESSION NUMBER: NCBI ACCESSION: NZ_KV804867.1
  ref <309>: DATABASE ENTRY DATE: 2019-04-01
  ref <313>: RELEVANT RESIDUES IN SEQ ID NO: (1)..(1556)
ttttatggagagtttgatcctggctcaggatgaacgctggcggcgtgcctaatacatgcaagtcgagcgaacagacgaggagcttgctcctctgacgttagcggcggacgggtgagtaacacgtggataacctacctataagactgggataacttcgggaaaccggagctaataccggataatatattgaaccgcatggttcaatagtgaaagacggttttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8831 - DNA, 1558 bp, Staphylococcus sp. HMSC034G07; identical to SEQ ID NO: 8820
  ref <308>: DATABASE ACCESSION NUMBER: NCBI ACCESSION: NZ_KV826599.1
  ref <309>: DATABASE ENTRY DATE: 2019-04-01
  ref <313>: RELEVANT RESIDUES IN SEQ ID NO: (1)..(1558)

SEQ ID NO: 8832 - DNA, 1467 bp, Staphylococcus sp. HMSC034G11
  ref <308>: DATABASE ACCESSION NUMBER: NCBI ACCESSION: NZ_KV803377.1
  ref <309>: DATABASE ENTRY DATE: 2019-04-01
  ref <313>: RELEVANT RESIDUES IN SEQ ID NO: (1)..(1467)
ctctgacgttagcggcggacgggtgagtaacacgtggataacctacctataagactgggataacttcgggaaaccggagctaataccggataatatattgaaccgcatggttcaatagtgaaagacggttttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8833 - DNA, 665 bp, Staphylococcus sp. HMSC035D11
  ref <308>: DATABASE ACCESSION NUMBER: NCBI ACCESSION: NZ_KV827213.1
  ref <309>: DATABASE ENTRY DATE: 2019-04-01
  ref <313>: RELEVANT RESIDUES IN SEQ ID NO: (1)..(665)
gggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaagga

SEQ ID NO: 8834 - DNA, 1557 bp, Staphylococcus sp. HMSC035F01
  ref <308>: DATABASE ACCESSION NUMBER: NCBI ACCESSION: NZ_KV827401.1
  ref <309>: DATABASE ENTRY DATE: 2019-04-01
  ref <313>: RELEVANT RESIDUES IN SEQ ID NO: (1)..(1557)
ttttatggagagtttgatcctggctcaggatgaacgctggcggcgtgcctaatacatgcaagtcgagcgaacggacgagaagcttgcttctctgatgttagcggcggacgggtgagtaacacgtggataacctacctataagactgggataacttcgggaaaccggagctaataccggataatattttgaaccgcatggttcaaaagtgaaagacggtcttgctgtcacttatagatggatccgcgctgcattagctagttggtaaggtaacggcttaccaaggcaacgatgcatagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatatgtgtaagtaactgtgcacatcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacaaatgattggggtgaagtcgtaacaaggtagccgtatcggaaggtgcggctggatcacctcctttctaa

SEQ ID NO: 8835 - DNA, 1460 bp, Staphylococcus sp. HMSC035F02
  ref <308>: DATABASE ACCESSION NUMBER: NCBI ACCESSION: NZ_KV827459.1
  ref <309>: DATABASE ENTRY DATE: 2019-04-01
  ref <313>: RELEVANT RESIDUES IN SEQ ID NO: (1)..(1460)
gttagcggcggacgggtgagtaacacgtaggtaacctacctataagactgggataacttcgggaaaccggagctaataccggataatatttcgaaccgcatggttcgatagtgaaagatggctttgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8836 - DNA, 1557 bp, Staphylococcus sp. HMSC035F11; identical to SEQ ID NO: 8834
  ref <308>: DATABASE ACCESSION NUMBER: NCBI ACCESSION: NZ_KV827578.1
  ref <309>: DATABASE ENTRY DATE: 2019-04-01
  ref <313>: RELEVANT RESIDUES IN SEQ ID NO: (1)..(1557)

SEQ ID NO: 8837 - DNA, 1556 bp, Staphylococcus sp. HMSC036A09
  ref <308>: DATABASE ACCESSION NUMBER: NCBI ACCESSION: NZ_KV827528.1
  ref <309>: DATABASE ENTRY DATE: 2019-04-01
  ref <313>: RELEVANT RESIDUES IN SEQ ID NO: (1)..(1556)
ttttatggagagtttgatcctggctcaggatgaacgctggcggcgtgcctaatacatgcaagtcgagcgaacagacgaggagcttgctcctctgacgttagcggcggacgggtgagtaacacgtggataacctacctataagactgggataacttcgggaaaccggagctaataccggataatatattgaaccgcatggttcaatagtgaaagacggttttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8838 - DNA, 1176 bp, Staphylococcus sp. HMSC036D05
  ref <308>: DATABASE ACCESSION NUMBER: NCBI ACCESSION: NZ_KV827777.1
  ref <309>: DATABASE ENTRY DATE: 2019-04-01
  ref <313>: RELEVANT RESIDUES IN SEQ ID NO: (1)..(1176)
gggcgaaagcctgacggagcaacgccgcgtgagtgatgaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtggcgaaaccgcgaggtcaagcaaatcccataaagttgttctcagttcggattgtagtctgcaactcgactacatgaagctggaatcgctagtaatcgtggatcagcatgccacggtgaatacgttcccgggtcttgtacacaccgcccgtcacaccacgagagtttgtaacacccgaagccggtggagtaaccttttggagctagccgtcgaaggtgggacaaatgattggggtgaagtcgtaacaaggtagccgtatcggaaggtgcggctggatcacctcctttctaagga

SEQ ID NO: 8839 - DNA, 1460 bp, Staphylococcus sp. HMSC055A09
  ref <308>: DATABASE ACCESSION NUMBER: NCBI ACCESSION: NZ_KV798357.1
  ref <309>: DATABASE ENTRY DATE: 2019-04-01
  ref <313>: RELEVANT RESIDUES IN SEQ ID NO: (1)..(1460)
gttagcggcggacgggtgagtaacacgtggataacctacctataagactgggataacttcgggaaaccggagctaataccggataacatgttgaaccgcatggttcaacagtgaaagacggtcttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgaagaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttggagctagccgtcgaaggtgggacaaatgattggggtgaagtcgtaacaaggtagccgtatcggaaggtgcggctggatcacctcctttctaa

SEQ ID NO: 8840 - DNA, 1046 bp, Staphylococcus sp. HMSC055A10
  ref <308>: DATABASE ACCESSION NUMBER: NCBI ACCESSION: NZ_KV819350.1
  ref <309>: DATABASE ENTRY DATE: 2019-04-01
  ref <313>: RELEVANT RESIDUES IN SEQ ID NO: (1)..(1046)
ttttatggagagtttgatcctggctcaggatgaacgctggcggcgtgcctaatacatgcaagtcgagcgaacagacgaggagcttgctcctctgacgttagcggcggacgggtgagtaacacgtggataacctacctataagactgggataacttcgggaaaccggagctaataccggataatatattgaaccgcatggttcaatagtgaaagacggttttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcggggg

SEQ ID NO: 8841 - DNA, 1556 bp, Staphylococcus sp. HMSC055B03; identical to SEQ ID NO: 8830
  ref <308>: DATABASE ACCESSION NUMBER: NCBI ACCESSION: NZ_KV815182.1
  ref <309>: DATABASE ENTRY DATE: 2019-04-01
  ref <313>: RELEVANT RESIDUES IN SEQ ID NO: (1)..(1556)

SEQ ID NO: 8842 - DNA, 1555 bp, Staphylococcus sp. HMSC055C03
  ref <308>: DATABASE ACCESSION NUMBER: NCBI ACCESSION: NZ_KV797489.1
  ref <309>: DATABASE ENTRY DATE: 2019-04-01
  ref <313>: RELEVANT RESIDUES IN SEQ ID NO: (1)..(1555)
ttatggagagtttgatcctggctcaggatgaacgctggcggcgtgcctaatacatgcaagtcgagcgaacagacgaggagcttgctcctctgacgttagcggcggacgggtgagtaacacgtgggtaacctacctataagactgggataactccgggaaaccggggctaataccggataacacatgaaaccgcatggtttcatgatgaaagacggttttgctgtcacttatagatggacccgcggcgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaagggtgtaagtaactgtgcatcccttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacggtacaaagggcagcgaacccgcgaggtcaagcaaatcccataaagccgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggaactagccgtcgaaggtgggacaaatgattggggtgaagtcgtaacaaggtagccgtatcggaaggtgcggctggatcacctcctttctaa

SEQ ID NO: 8843 - DNA, 1349 bp, Staphylococcus sp. HMSC055G07
  ref <308>: DATABASE ACCESSION NUMBER: NCBI ACCESSION: NZ_KV828045.1
  ref <309>: DATABASE ENTRY DATE: 2019-04-01
  ref <313>: RELEVANT RESIDUES IN SEQ ID NO: (1)..(1349)
gagtaacacgtgggtaacctacctataagactgggacaacttcgggaaaccggagctaataccggataatatgttgaaccgcatggttcaatagtgaaagatggttttgctatcacttatagatggacccgcgccgtattagctagttggtgaggtaacggctcaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttaggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcatttagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatt

SEQ ID NO: 8844 - DNA, 1557 bp, Staphylococcus sp. HMSC055H04; identical to SEQ ID NO: 8834
  ref <308>: DATABASE ACCESSION NUMBER: NCBI ACCESSION: NZ_KV806551.1
  ref <309>: DATABASE ENTRY DATE: 2019-04-01
  ref <313>: RELEVANT RESIDUES IN SEQ ID NO: (1)..(1557)

SEQ ID NO: 8845 - DNA, 1557 bp, Staphylococcus sp. HMSC055H07; identical to SEQ ID NO: 8834
  ref <308>: DATABASE ACCESSION NUMBER: NCBI ACCESSION: NZ_KV821407.1
  ref <309>: DATABASE ENTRY DATE: 2019-04-01
  ref <313>: RELEVANT RESIDUES IN SEQ ID NO: (1)..(1557)

SEQ ID NO: 8846 - DNA, 583 bp, Staphylococcus sp. HMSC056D08
  ref <308>: DATABASE ACCESSION NUMBER: NCBI ACCESSION: NZ_KV836985.1
  ref <309>: DATABASE ENTRY DATE: 2019-04-01
  ref <313>: RELEVANT RESIDUES IN SEQ ID NO: (1)..(583)
gagtaacacgtgggtaacctacctataagactgggataactccgggaaaccggggctaataccggataacacatgaaaccgcatggtttcatgatgaaagacggttttgctgtcacttatagatggacccgcggcgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaggatgtaagtaactatgcatcccttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtag

SEQ ID NO: 8847 - DNA, 1555 bp, Staphylococcus sp. HMSC056G08
  ref <308>: DATABASE ACCESSION NUMBER: NCBI ACCESSION: NZ_KV808434.1
  ref <309>: DATABASE ENTRY DATE: 2019-04-01
  ref <313>: RELEVANT RESIDUES IN SEQ ID NO: (1)..(1555)
ttatggagagtttgatcctggctcaggatgaacgctggcggcgtgcctaatacatgcaagtcgagcgaacagacgaggagcttgctcctctgacgttagcggcggacgggtgagtaacacgtgggtaacctacctataagactgggataactccgggaaaccggggctaataccggataatacatgaaaccgcatggtttcatgatgaaagacggttttgctgtcacttatagatggacccgcggcgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaggatgtaagtaactgtgcatcccttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacggtacaaagggcagcgaacccgcgaggtcaagcaaatcccataaagccgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggaactagccgtcgaaggtgggacaaatgattggggtgaagtcgtaacaaggtagccgtatcggaaggtgcggctggatcacctcctttctaa

SEQ ID NO: 8848 - DNA, 1460 bp, Staphylococcus sp. HMSC057A02; identical to SEQ ID NO: 8835
  ref <308>: DATABASE ACCESSION NUMBER: NCBI ACCESSION: NZ_KV804601.1
  ref <309>: DATABASE ENTRY DATE: 2019-04-01
  ref <313>: RELEVANT RESIDUES IN SEQ ID NO: (1)..(1460)

SEQ ID NO: 8849 - DNA, 1556 bp, Staphylococcus sp. HMSC057A08
  ref <308>: DATABASE ACCESSION NUMBER: NCBI ACCESSION: NZ_KV810863.1
  ref <309>: DATABASE ENTRY DATE: 2019-04-01
  ref <313>: RELEVANT RESIDUES IN SEQ ID NO: (1)..(1556)
ttttatggagagtttgatcctggctcaggatgaacgctggcggcgtgcctaatacatgcaagtcgagcgaacagacgaggagcttgctcctttgacgttagcggcggacgggtgagtaacacgtgggtaacctacctataagactgggataacttcgggaaaccggagctaataccggataatatttcgaaccgcatggttcgatagtgaaagatggctctgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8850 - DNA, 1557 bp, Staphylococcus sp. HMSC057B01
  ref <308>: DATABASE ACCESSION NUMBER: NCBI ACCESSION: NZ_KV828216.1
  ref <309>: DATABASE ENTRY DATE: 2019-04-01
  ref <313>: RELEVANT RESIDUES IN SEQ ID NO: (1)..(1557)
ttttatggagagtttgatcctggctcaggatgaacgctggcggcgtgcctaatacatgcaagtcgagcgaacggacgagaagcttgcttctctgatgttagcggcggacgggtgagtaacacgtggataacctacctataagactgggataacttcgggaaaccggagctaataccggataatattttgaaccgcatggttcaaaagtgaaagacggtcttgctgtcacttatagatggatccgcgctgcattagctagttggtaaggtaacggcttaccaaggcaacgatgcatagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatatgtgtaagtaactgtgcacatcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacaaatgattggggtgaagtcgtaacaaggtagccgtatcggaaggtgcggctggatcacctcctttctaa

SEQ ID NO: 8851 - DNA, 1447 bp, Staphylococcus sp. HMSC057C08
  ref <308>: DATABASE ACCESSION NUMBER: NCBI ACCESSION: NZ_KV818503.1
  ref <309>: DATABASE ENTRY DATE: 2019-04-01
  ref <313>: RELEVANT RESIDUES IN SEQ ID NO: (1)..(1447)
gagtaacacgtgggtaacctacctataagactgggataactccgggaaaccggggctaataccggataatacatgaaaccgcatggtttcatgatgaaagacggttttgctgtcacttatagatggacccgcggcgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaggatgtaagtaactatgcatcccttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacggtacaaagggcagcgaacccgcgaggtcaagcaaatcccataaagccgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggaactagccgtcgaaggtgggacaaatgattggggtgaagtcgtaacaaggtagccgtatcggaaggtgcggctggatcacctcctttctaagga

SEQ ID NO: 8852 - DNA, 1556 bp, Staphylococcus sp. HMSC057G10
  ref <308>: DATABASE ACCESSION NUMBER: NCBI ACCESSION: NZ_KV828326.1
  ref <309>: DATABASE ENTRY DATE: 2019-04-01
  ref <313>: RELEVANT RESIDUES IN SEQ ID NO: (1)..(1556)
ttttatggagagtttgatcctggctcaggatgaacgctggcggcgtgcctaatacatgcaagtcgagcgaacagacaaggagcttgctcctttgacgttagcggcggacgggtgagtaacacgtgggtaacctacctataagactgggataacttcgggaaaccggagctaataccggataatatttcgaaccgcatggttcgatagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatacgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8853 - DNA, 1556 bp, Staphylococcus sp. HMSC058D09; identical to SEQ ID NO: 8829
  ref <308>: DATABASE ACCESSION NUMBER: NCBI ACCESSION: NZ_KV797656.1
  ref <309>: DATABASE ENTRY DATE: 2019-04-01
  ref <313>: RELEVANT RESIDUES IN SEQ ID NO: (1)..(1556)

SEQ ID NO: 8854 - DNA, 1557 bp, Staphylococcus sp. HMSC058E01; identical to SEQ ID NO: 8834
  ref <308>: DATABASE ACCESSION NUMBER: NCBI ACCESSION: NZ_KV828667.1
  ref <309>: DATABASE ENTRY DATE: 2019-04-01
  ref <313>: RELEVANT RESIDUES IN SEQ ID NO: (1)..(1557)

SEQ ID NO: 8855 - DNA, 1556 bp, Staphylococcus sp. HMSC058E03
  ref <308>: DATABASE ACCESSION NUMBER: NCBI ACCESSION: NZ_KV828739.1
  ref <309>: DATABASE ENTRY DATE: 2019-04-01
  ref <313>: RELEVANT RESIDUES IN SEQ ID NO: (1)..(1556)
ttttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactgggacaacttcgggaaaccggagctaataccggataatatgttgaaccgcatggttcaatagtgaaagatggttttgctatcacttatagatggacccgcgccgtattagctagttggtgaggtaacggctcaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttaggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcatttagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8856 - DNA, 693 bp, Staphylococcus sp. HMSC058E12
  ref <308>: DATABASE ACCESSION NUMBER: NCBI ACCESSION: NZ_KV828775.1
  ref <309>: DATABASE ENTRY DATE: 2019-04-01
  ref <313>: RELEVANT RESIDUES IN SEQ ID NO: (1)..(693)
gcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaagga

SEQ ID NO: 8857 - DNA, 1099 bp, Staphylococcus sp. HMSC059E03
  ref <308>: DATABASE ACCESSION NUMBER: NCBI ACCESSION: NZ_KV800237.1
  ref <309>: DATABASE ENTRY DATE: 2019-04-01
  ref <313>: RELEVANT RESIDUES IN SEQ ID NO: (1)..(1099)
aagggtgtaagtaactgtgcatcccttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacggtacaaagggcagcgaacccgcgaggtcaagcaaatcccataaagccgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggaactagccgtcgaaggtgggacaaatgattggggtgaagtcgtaacaaggtagccgtatcggaaggtgcggctggatcacctcctttctaagga

SEQ ID NO: 8858 - DNA, 1556 bp, Staphylococcus sp. HMSC059F04
  ref <308>: DATABASE ACCESSION NUMBER: NCBI ACCESSION: NZ_KV809469.1
  ref <309>: DATABASE ENTRY DATE: 2019-04-01
  ref <313>: RELEVANT RESIDUES IN SEQ ID NO: (1)..(1556)
ttttatggagagtttgatcctggctcaggatgaacgctggcggcgtgcctaatacatgcaagtcgagcgaacagatgaggagcttgctcctttgacgttagcggcggacgggtgagtaacacgtgggtaacctacctataagactgggacaacttcgggaaaccggagctaataccggataatatgttgaaccgcatggttcaatagtgaaagatggttttgctatcacttatagatggacccgcgccgtattagctagttggtgaggtaacggctcaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttaggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcatttagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8859 - DNA, 1556 bp, Staphylococcus sp. HMSC059G05; identical to SEQ ID NO: 8829
  ref <308>: DATABASE ACCESSION NUMBER: NCBI ACCESSION: NZ_KV799193.1
  ref <309>: DATABASE ENTRY DATE: 2019-04-01
  ref <313>: RELEVANT RESIDUES IN SEQ ID NO: (1)..(1556)

SEQ ID NO: 8860 - DNA, 1556 bp, Staphylococcus sp. HMSC060A04
  ref <308>: DATABASE ACCESSION NUMBER: NCBI ACCESSION: NZ_KV828984.1
  ref <309>: DATABASE ENTRY DATE: 2019-04-01
  ref <313>: RELEVANT RESIDUES IN SEQ ID NO: (1)..(1556)
ttttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactgggacaacttcgggaaaccggagctaataccggataatatgttgaaccgcatggttcaatagtgaaagatggttttgctatcacttatagatggacctgcgccgtattagctagttggtgaggtaacggctcaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttaggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcatttagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccattcggagctagccgtcgaaggtgggacaaatgattggggtgaagtcgtaacaaggtagccgtatcggaaggtgcggctggatcacctcctttctaa

SEQ ID NO: 8861 - DNA, 1557 bp, Staphylococcus sp. HMSC060D01; identical to SEQ ID NO: 8834
  ref <308>: DATABASE ACCESSION NUMBER: NCBI ACCESSION: NZ_KV820736.1
  ref <309>: DATABASE ENTRY DATE: 2019-04-01
  ref <313>: RELEVANT RESIDUES IN SEQ ID NO: (1)..(1557)

SEQ ID NO: 8862 - DNA, 1557 bp, Staphylococcus sp. HMSC060D12; identical to SEQ ID NO: 8834
  ref <308>: DATABASE ACCESSION NUMBER: NCBI ACCESSION: NZ_KV829628.1
  ref <309>: DATABASE ENTRY DATE: 2019-04-01
  ref <313>: RELEVANT RESIDUES IN SEQ ID NO: (1)..(1557)

SEQ ID NO: 8863 - DNA, 1556 bp, Staphylococcus sp. HMSC061C10; identical to SEQ ID NO: 8855
  ref <308>: DATABASE ACCESSION NUMBER: NCBI ACCESSION: NZ_KV830274.1
  ref <309>: DATABASE ENTRY DATE: 2019-04-01
  ref <313>: RELEVANT RESIDUES IN SEQ ID NO: (1)..(1556)

SEQ ID NO: 8864 - DNA, 780 bp, Staphylococcus sp. HMSC061F01
  ref <308>: DATABASE ACCESSION NUMBER: NCBI ACCESSION: NZ_KV837270.1
  ref <309>: DATABASE ENTRY DATE: 2019-04-01
  ref <313>: RELEVANT RESIDUES IN SEQ ID NO: (1)..(780)
taataccggataatatttcgaaccgcatggttcgatagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatacgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagc

SEQ ID NO: 8865 - DNA, 1050 bp, Staphylococcus sp. HMSC061F10
  ref <308>: DATABASE ACCESSION NUMBER: NCBI ACCESSION: NZ_KV830412.1
  ref <309>: DATABASE ENTRY DATE: 2019-04-01
  ref <313>: RELEVANT RESIDUES IN SEQ ID NO: (1)..(1050)
cacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaagga

SEQ ID NO: 8866 - DNA, 1556 bp, Staphylococcus sp. HMSC061G04; identical to SEQ ID NO: 8852
  ref <308>: DATABASE ACCESSION NUMBER: NCBI ACCESSION: NZ_KV830535.1
  ref <309>: DATABASE ENTRY DATE: 2019-04-01
  ref <313>: RELEVANT RESIDUES IN SEQ ID NO: (1)..(1556)

SEQ ID NO: 8867 - DNA, 485 bp, Staphylococcus sp. HMSC061G12
  ref <308>: DATABASE ACCESSION NUMBER: NCBI ACCESSION: NZ_KV837035.1
  ref <309>: DATABASE ENTRY DATE: 2019-04-01
  ref <313>: RELEVANT RESIDUES IN SEQ ID NO: (1)..(485)
acggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttacca

SEQ ID NO: 8868 - DNA, 1556 bp, Staphylococcus sp. HMSC061H04; identical to SEQ ID NO: 8852
  ref <308>: DATABASE ACCESSION NUMBER: NCBI ACCESSION: NZ_KV820267.1
  ref <309>: DATABASE ENTRY DATE: 2019-04-01
  ref <313>: RELEVANT RESIDUES IN SEQ ID NO: (1)..(1556)

SEQ ID NO: 8869 - DNA, 1556 bp, Staphylococcus sp. HMSC062A01
  ref <308>: DATABASE ACCESSION NUMBER: NCBI ACCESSION: NZ_KV830633.1
  ref <309>: DATABASE ENTRY DATE: 2019-04-01
  ref <313>: RELEVANT RESIDUES IN SEQ ID NO: (1)..(1556)
ttttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactgggataacttcgggaaaccggagctaataccggataatatttcgaaccgcatggttcgatagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgatgaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8870 - DNA, 1556 bp, Staphylococcus sp. HMSC062A05; identical to SEQ ID NO: 8855
  ref <308>: DATABASE ACCESSION NUMBER: NCBI ACCESSION: NZ_KV830649.1
  ref <309>: DATABASE ENTRY DATE: 2019-04-01
  ref <313>: RELEVANT RESIDUES IN SEQ ID NO: (1)..(1556)

SEQ ID NO: 8871 - DNA, 819 bp, Staphylococcus sp. HMSC062B11
  ref <308>: DATABASE ACCESSION NUMBER: NCBI ACCESSION: NZ_KV817929.1
  ref <309>: DATABASE ENTRY DATE: 2019-04-01
  ref <313>: RELEVANT RESIDUES IN SEQ ID NO: (1)..(819)
aatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgagg

SEQ ID NO: 8872 - DNA, 953 bp, Staphylococcus sp. HMSC062C01
  ref <308>: DATABASE ACCESSION NUMBER: NCBI ACCESSION: NZ_KV799156.1
  ref <309>: DATABASE ENTRY DATE: 2019-04-01
  ref <313>: RELEVANT RESIDUES IN SEQ ID NO: (1)..(953)
gacgttagcggcggacgggtgagtaacacgtaggtaacctacctataagactgggataacttcgggaaaccggagctaataccggataatatttcgaaccgcatggttcgatagtgaaagatggctttgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcggggg

SEQ ID NO: 8873 - DNA, 1446 bp, Staphylococcus sp. HMSC062C03
  ref <308>: DATABASE ACCESSION NUMBER: NCBI ACCESSION: NZ_KV830698.1
  ref <309>: DATABASE ENTRY DATE: 2019-04-01
  ref <313>: RELEVANT RESIDUES IN SEQ ID NO: (1)..(1446)
gagtaacacgtgggtaacctacctataagactgggataacttcgggaaaccggagctaataccggataatatttcgaaccgcatggttcgatagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatacgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaagga

SEQ ID NO: 8874 - DNA, 548 bp, Staphylococcus sp. HMSC062D04
  ref <308>: DATABASE ACCESSION NUMBER: NCBI ACCESSION: NZ_KV805924.1
  ref <309>: DATABASE ENTRY DATE: 2019-04-01
  ref <313>: RELEVANT RESIDUES IN SEQ ID NO: (1)..(548)
gcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagata

SEQ ID NO: 8875 - DNA, 802 bp, Staphylococcus sp. HMSC062D12
  ref <308>: DATABASE ACCESSION NUMBER: NCBI ACCESSION: NZ_KV830771.1
  ref <309>: DATABASE ENTRY DATE: 2019-04-01
  ref <313>: RELEVANT RESIDUES IN SEQ ID NO: (1)..(802)
gttagcggcggacgggtggagtaacacgtgggtaacctacctataagactgggacaacttcgggaaaccggagctaataccggataatatgttgaaccgcatggttcaatagtgaaagatggttttgctatcacttatagatggacccgcgccgtattagctagttggtgaggtaacggctcaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttaggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgccttggg

SEQ ID NO: 8876 - DNA, 1031 bp, Staphylococcus sp. HMSC062E08
  ref <308>: DATABASE ACCESSION NUMBER: NCBI ACCESSION: NZ_KV830834.1
  ref <309>: DATABASE ENTRY DATE: 2019-04-01
  ref <313>: RELEVANT RESIDUES IN SEQ ID NO: (1)..(1031)
ttttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactgggacaacttcgggaaaccggagctaataccggataatatgttgaaccgcatggttcaatagtgaaagatggttttgctatcacttatagatggacccgcgccgtattagctagttggtgaggtaacggctcaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttaggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagt

SEQ ID NO: 8877 - DNA, 1446 bp, Staphylococcus sp. HMSC062E10
  ref <308>: DATABASE ACCESSION NUMBER: NCBI ACCESSION: NZ_KV795680.1
  ref <309>: DATABASE ENTRY DATE: 2019-04-01
  ref <313>: RELEVANT RESIDUES IN SEQ ID NO: (1)..(1446)
gagtaacacgtgggtaacctacctataagactgggacaacttcgggaaaccggagctaataccggataatatgttgaaccgcatggttcaatagtgaaagatggttttgctatcacttatagatggacccgcgccgtattagctagttggtgaggtaacggctcaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttaggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcatttagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaagga

SEQ ID NO: 8878 - DNA, 921 bp, Staphylococcus sp. HMSC062H10
  ref <308>: DATABASE ACCESSION NUMBER: NCBI ACCESSION: NZ_KV830991.1
  ref <309>: DATABASE ENTRY DATE: 2019-04-01
  ref <313>: RELEVANT RESIDUES IN SEQ ID NO: (1)..(921)
gtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacaaatgattggggtgaagtcgtaacaaggtagccgtatcggaaggtgcggctggatcacctcctttctaagga

SEQ ID NO: 8879 - DNA, 1556 bp, Staphylococcus sp. HMSC063A07
  ref <308>: DATABASE ACCESSION NUMBER: NCBI ACCESSION: NZ_KV830915.1
  ref <309>: DATABASE ENTRY DATE: 2019-04-01
  ref <313>: RELEVANT RESIDUES IN SEQ ID NO: (1)..(1556)
ttttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactgggacaacttcgggaaaccggagctaataccggataatatgttgaaccgcatggttcaatagtgaaagatggttttgctatcacttatagatggacccgcgccgtattagctagttggtgaggtaacggctcaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttaggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagttttccccttcgggggacaaagtgacaggtggtgcatggttgtcgtcagctcgtgtcgtgagatgttgggttaagtcccgcaacgagcgcaacccttaagcttagttgccatcatttagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8880 - DNA, 1556 bp, Staphylococcus sp. HMSC063A11
  ref <308>: DATABASE ACCESSION NUMBER: NCBI ACCESSION: NZ_KV831119.1
  ref <309>: DATABASE ENTRY DATE: 2019-04-01
  ref <313>: RELEVANT RESIDUES IN SEQ ID NO: (1)..(1556)
ttttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactgggataacttcgggaaaccggagctaataccggataatatttcgaaccgcatggttcgatagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8881 - DNA, 1556 bp, Staphylococcus sp. HMSC063D03
  ref <308>: DATABASE ACCESSION NUMBER: NCBI ACCESSION: NZ_KV831169.1
  ref <309>: DATABASE ENTRY DATE: 2019-04-01
  ref <313>: RELEVANT RESIDUES IN SEQ ID NO: (1)..(1556)
ttttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactgggacaacttcgggaaaccggagctaataccggataatatgttgaaccgcatggttcaatagtgaaagatggttttgctatcacttatagatggacccgcgccgtattagctagttggtgaggtaatggctcaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttaggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcatttagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8882 - DNA, 1556 bp, Staphylococcus sp. HMSC063E12; identical to SEQ ID NO: 8855
  ref <308>: DATABASE ACCESSION NUMBER: NCBI ACCESSION: NZ_KV831195.1
  ref <309>: DATABASE ENTRY DATE: 2019-04-01
  ref <313>: RELEVANT RESIDUES IN SEQ ID NO: (1)..(1556)

SEQ ID NO: 8883 - DNA, 1463 bp, Staphylococcus sp. HMSC063F02
  ref <308>: DATABASE ACCESSION NUMBER: NCBI ACCESSION: NZ_KV811436.1
  ref <309>: DATABASE ENTRY DATE: 2019-04-01
  ref <313>: RELEVANT RESIDUES IN SEQ ID NO: (1)..(1463)
gacgttagcggcggacgggtgagtaacacgtaggtaacctacctataagactgggataacttcgggaaaccggagctaataccggataatatttcgaaccgcatggttcgatagtgaaagatggctttgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8884 - DNA, 1556 bp, Staphylococcus sp. HMSC063F03; identical to SEQ ID NO: 8830
  ref <308>: DATABASE ACCESSION NUMBER: NCBI ACCESSION: NZ_KV831275.1
  ref <309>: DATABASE ENTRY DATE: 2019-04-01
  ref <313>: RELEVANT RESIDUES IN SEQ ID NO: (1)..(1556)

SEQ ID NO: 8885 - DNA, 1556 bp, Staphylococcus sp. HMSC063F05; identical to SEQ ID NO: 8830
  ref <308>: DATABASE ACCESSION NUMBER: NCBI ACCESSION: NZ_KV831312.1
  ref <309>: DATABASE ENTRY DATE: 2019-04-01
  ref <313>: RELEVANT RESIDUES IN SEQ ID NO: (1)..(1556)

SEQ ID NO: 8886 - DNA, 473 bp, Staphylococcus sp. HMSC063F10
  ref <308>: DATABASE ACCESSION NUMBER: NCBI ACCESSION: NZ_KV831426.1
  ref <309>: DATABASE ENTRY DATE: 2019-04-01
  ref <313>: RELEVANT RESIDUES IN SEQ ID NO: (1)..(473)
actcctacgggaggcagcagtagggaatcttccgcaatgggcgaaagcctgacggagcaacgccgcgtgagtgatgaaggtcttaggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgc

SEQ ID NO: 8887 - DNA, 1557 bp, Staphylococcus sp. HMSC063G01; identical to SEQ ID NO: 8834
  ref <308>: DATABASE ACCESSION NUMBER: NCBI ACCESSION: NZ_KV812328.1
  ref <309>: DATABASE ENTRY DATE: 2019-04-01
  ref <313>: RELEVANT RESIDUES IN SEQ ID NO: (1)..(1557)

SEQ ID NO: 8888 - DNA, 1557 bp, Staphylococcus sp. HMSC063H12; identical to SEQ ID NO: 8834
  ref <308>: DATABASE ACCESSION NUMBER: NCBI ACCESSION: NZ_KV831450.1
  ref <309>: DATABASE ENTRY DATE: 2019-04-01
  ref <313>: RELEVANT RESIDUES IN SEQ ID NO: (1)..(1557)

SEQ ID NO: 8889 - DNA, 1556 bp, Staphylococcus sp. HMSC064A01; identical to SEQ ID NO: 8855
  ref <308>: DATABASE ACCESSION NUMBER: NCBI ACCESSION: NZ_KV831608.1
  ref <309>: DATABASE ENTRY DATE: 2019-04-01
  ref <313>: RELEVANT RESIDUES IN SEQ ID NO: (1)..(1556)

SEQ ID NO: 8890 - DNA, 1556 bp, Staphylococcus sp. HMSC064A09; identical to SEQ ID NO: 8855
  ref <308>: DATABASE ACCESSION NUMBER: NCBI ACCESSION: NZ_KV831545.1
  ref <309>: DATABASE ENTRY DATE: 2019-04-01
  ref <313>: RELEVANT RESIDUES IN SEQ ID NO: (1)..(1556)

SEQ ID NO: 8891 - DNA, 1556 bp, Staphylococcus sp. HMSC064E03; identical to SEQ ID NO: 8880
  ref <308>: DATABASE ACCESSION NUMBER: NCBI ACCESSION: NZ_KV831786.1
  ref <309>: DATABASE ENTRY DATE: 2019-04-01
  ref <313>: RELEVANT RESIDUES IN SEQ ID NO: (1)..(1556)

SEQ ID NO: 8892 - DNA, 831 bp, Staphylococcus sp. HMSC064E11
  ref <308>: DATABASE ACCESSION NUMBER: NCBI ACCESSION: NZ_KV797884.1
  ref <309>: DATABASE ENTRY DATE: 2019-04-01
  ref <313>: RELEVANT RESIDUES IN SEQ ID NO: (1)..(831)
tttttatgagagtttgatcctggctcaggacgaacgctggcggcgtgcctaatacatgcaagtcgaacgcttctttttccaccggagcttgctccaccggaaaaagaggagtggcgaacgggtgagtaacacgtgggtaacctgcccatcagaaggggataacacttggaaacaggtgctaataccgtataacaatcaaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccg

SEQ ID NO: 8893 - DNA, 1172 bp, Staphylococcus sp. HMSC065A08
  ref <308>: DATABASE ACCESSION NUMBER: NCBI ACCESSION: NZ_KV812597.1
  ref <309>: DATABASE ENTRY DATE: 2019-04-01
  ref <313>: RELEVANT RESIDUES IN SEQ ID NO: (1)..(1172)
gagtaacacgtgggtaacctacctataagactggaataactccgggaaaccggggctaatgccggataacatttagaaccgcatggttctaaagtgaaagatggttttgctatcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacaatacaaagggcagctaaaccgcgaggtcat

SEQ ID NO: 8894 - DNA, 1556 bp, Staphylococcus sp. HMSC065C09; identical to SEQ ID NO: 8880
  ref <308>: DATABASE ACCESSION NUMBER: NCBI ACCESSION: NZ_KV809397.1
  ref <309>: DATABASE ENTRY DATE: 2019-04-01
  ref <313>: RELEVANT RESIDUES IN SEQ ID NO: (1)..(1556)

SEQ ID NO: 8895 - DNA, 1556 bp, Staphylococcus sp. HMSC065C10
  ref <308>: DATABASE ACCESSION NUMBER: NCBI ACCESSION: NZ_KV806632.1
  ref <309>: DATABASE ENTRY DATE: 2019-04-01
  ref <313>: RELEVANT RESIDUES IN SEQ ID NO: (1)..(1556)
ttttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactgggataacttcgggaaaccggagctaataccggataatatttcgaaccgcatggttcgatagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8896 - DNA, 1556 bp, Staphylococcus sp. HMSC065D05; identical to SEQ ID NO: 8837
  ref <308>: DATABASE ACCESSION NUMBER: NCBI ACCESSION: NZ_KV811750.1
  ref <309>: DATABASE ENTRY DATE: 2019-04-01
  ref <313>: RELEVANT RESIDUES IN SEQ ID NO: (1)..(1556)

SEQ ID NO: 8897 - DNA, 1030 bp, Staphylococcus sp. HMSC065D11
  ref <308>: DATABASE ACCESSION NUMBER: NCBI ACCESSION: NZ_KV811849.1
  ref <309>: DATABASE ENTRY DATE: 2019-04-01
  ref <313>: RELEVANT RESIDUES IN SEQ ID NO: (1)..(1030)
ttttatggagagtttgatcctggctcaggatgaacgctggcggcgtgcctaatacatgcaagtcgagcgaacagacgaggagcttgctcctctgacgttagcggcggacgggtgagtaacacgtggataacctacctataagactgggataacttcgggaaaccggagctaataccggataatatattgaaccgcatggttcaatagtgaaagacggttttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagag

SEQ ID NO: 8898 - DNA, 1556 bp, Staphylococcus sp. HMSC065E07; identical to SEQ ID NO: 8881
  ref <308>: DATABASE ACCESSION NUMBER: NCBI ACCESSION: NZ_KV807462.1
  ref <309>: DATABASE ENTRY DATE: 2019-04-01
  ref <313>: RELEVANT RESIDUES IN SEQ ID NO: (1)..(1556)

SEQ ID NO: 8899 - DNA, 1557 bp, Staphylococcus sp. HMSC065E08
  ref <308>: DATABASE ACCESSION NUMBER: NCBI ACCESSION: NZ_KV819378.1
  ref <309>: DATABASE ENTRY DATE: 2019-04-01
  ref <313>: RELEVANT RESIDUES IN SEQ ID NO: (1)..(1557)
ttttatggagagtttgatcctggctcaggatgaacgctggcggcgtgcctaatacatgcaagtcgagcgaacagatgaggagcttgctcctctgacgttagcggcggacgggtgagtaacacgtgggtaacctacctataagactggaataactccgggaaaccggggctaatgccggataatatgcggaaccgcatggttctgcaatgaaagacggtcttgctgtcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaagtgcgtaggtaactatgcgcaccttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggttgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacagtacaaagggcagcgaaaccgcgaggtcaagcaaatcccataaagctgttctcagttcggattgtagtctgcaactcgactacatgaagctggaatcgctagtaatcgtagatcagcatgctacggtgaatacgttcccgggtcttgtacacaccgcccgtcacaccacgagagttcgtaacacccgaagccggtggagtaaccttttaggagctagccgtcgaaggtgggacgaatgattggggtgaagtcgtaacaaggtagccgtatcggaaggtgcggctggatcacctcctttctaa

SEQ ID NO: 8900 - DNA, 1464 bp, Staphylococcus sp. HMSC066C03
  ref <308>: DATABASE ACCESSION NUMBER: NCBI ACCESSION: NZ_KV812386.1
  ref <309>: DATABASE ENTRY DATE: 2019-04-01
  ref <313>: RELEVANT RESIDUES IN SEQ ID NO: (1)..(1464)
tgacgttagcggcggacgggtgagtaacacgtggataacctacctataagactgggataacttcgggaaaccggagctaataccggataacatgttgaaccgcatggttcaacagtgaaagacggtcttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgaagaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttggagctagccgtcgaaggtgggacaaatgattggggtgaagtcgtaacaaggtagccgtatcggaaggtgcggctggatcacctcctttctaa

SEQ ID NO: 8901 - DNA, 1556 bp, Staphylococcus sp. HMSC066G04; identical to SEQ ID NO: 8830
  ref <308>: DATABASE ACCESSION NUMBER: NCBI ACCESSION: NZ_KV808570.1
  ref <309>: DATABASE ENTRY DATE: 2019-04-01
  ref <313>: RELEVANT RESIDUES IN SEQ ID NO: (1)..(1556)

SEQ ID NO: 8902 - DNA, 1467 bp, Staphylococcus sp. HMSC067B04; identical to SEQ ID NO: 8832
  ref <308>: DATABASE ACCESSION NUMBER: NCBI ACCESSION: NZ_KV808313.1
  ref <309>: DATABASE ENTRY DATE: 2019-04-01
  ref <313>: RELEVANT RESIDUES IN SEQ ID NO: (1)..(1467)

SEQ ID NO: 8903 - DNA, 850 bp, Staphylococcus sp. HMSC067F07
  ref <308>: DATABASE ACCESSION NUMBER: NCBI ACCESSION: NZ_KV832235.1
  ref <309>: DATABASE ENTRY DATE: 2019-04-01
  ref <313>: RELEVANT RESIDUES IN SEQ ID NO: (1)..(850)
ttttatggagagtttgatcctggctcaggatgaacgctggcggcgtgcctaatacatgcaagtcgagcgaacagacgaggagcttgctcctctgacgttagcggcggacgggtgagtaacacgtggataacctacctataagactgggataacttcgggaaaccggagctaataccggataacatgttgaaccgcatggttcaacagtgaaagacggtcttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgaagaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtt

SEQ ID NO: 8904 - DNA, 1557 bp, Staphylococcus sp. HMSC067F10; identical to SEQ ID NO: 8834
  ref <308>: DATABASE ACCESSION NUMBER: NCBI ACCESSION: NZ_KV819211.1
  ref <309>: DATABASE ENTRY DATE: 2019-04-01
  ref <313>: RELEVANT RESIDUES IN SEQ ID NO: (1)..(1557)

SEQ ID NO: 8905 - DNA, 1556 bp, Staphylococcus sp. HMSC067G10; identical to SEQ ID NO: 8852
  ref <308>: DATABASE ACCESSION NUMBER: NCBI ACCESSION: NZ_KV832291.1
  ref <309>: DATABASE ENTRY DATE: 2019-04-01
  ref <313>: RELEVANT RESIDUES IN SEQ ID NO: (1)..(1556)

SEQ ID NO: 8906 - DNA, 490 bp, Staphylococcus sp. HMSC068C09
  ref <308>: DATABASE ACCESSION NUMBER: NCBI ACCESSION: NZ_KV813743.1
  ref <309>: DATABASE ENTRY DATE: 2019-04-01
  ref <313>: RELEVANT RESIDUES IN SEQ ID NO: (1)..(490)
tttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtc

SEQ ID NO: 8907 - DNA, 1304 bp, Staphylococcus sp. HMSC068D03
  ref <308>: DATABASE ACCESSION NUMBER: NCBI ACCESSION: NZ_KV832365.1
  ref <309>: DATABASE ENTRY DATE: 2019-04-01
  ref <313>: RELEVANT RESIDUES IN SEQ ID NO: (1)..(1304)
ttttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactgggataacttcgggaaaccggagctaataccggataatatttcgaaccgcatggttcgatagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgt

SEQ ID NO: 8908 - DNA, 981 bp, Staphylococcus sp. HMSC068D05
  ref <308>: DATABASE ACCESSION NUMBER: NCBI ACCESSION: NZ_KV812749.1
  ref <309>: DATABASE ENTRY DATE: 2019-04-01
  ref <313>: RELEVANT RESIDUES IN SEQ ID NO: (1)..(981)
tcctttgacgttagcggcggacgggtgagtaacacgtgggtaacctacctataagactgggacaacttcgggaaaccggagctaataccggataatatgttgaaccgcatggttcaatagtgaaagatggttttgctatcacttatagatggacccgcgccgtattagctagttggtgaggtaacggctcaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttaggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatg

SEQ ID NO: 8909 - DNA, 1556 bp, Staphylococcus sp. HMSC068D07; identical to SEQ ID NO: 8829
  ref <308>: DATABASE ACCESSION NUMBER: NCBI ACCESSION: NZ_KV799087.1
  ref <309>: DATABASE ENTRY DATE: 2019-04-01
  ref <313>: RELEVANT RESIDUES IN SEQ ID NO: (1)..(1556)

SEQ ID NO: 8910 - DNA, 1556 bp, Staphylococcus sp. HMSC068D08; identical to SEQ ID NO: 8855
  ref <308>: DATABASE ACCESSION NUMBER: NCBI ACCESSION: NZ_KV799559.1
  ref <309>: DATABASE ENTRY DATE: 2019-04-01
  ref <313>: RELEVANT RESIDUES IN SEQ ID NO: (1)..(1556)

SEQ ID NO: 8911 - DNA, 1525 bp, Staphylococcus sp. HMSC068G03
  ref <308>: DATABASE ACCESSION NUMBER: NCBI ACCESSION: NZ_KV817131.1
  ref <309>: DATABASE ENTRY DATE: 2019-04-01
  ref <313>: RELEVANT RESIDUES IN SEQ ID NO: (1)..(1525)
gaacgctggcggcgtgcctaatacatgcaagtcgagcgaacagataaggagcttgctcctttgacgttagcggcggacgggtgagtaacacgtgggtaacctacctataagactgggacaacttcgggaaaccggagctaataccggataatatgttgaaccgcatggttcaatagtgaaagatggttttgctatcacttatagatggacccgcgccgtattagctagttggtgaggtaacggctcaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttaggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcatttagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8912 - DNA, 1443 bp, Staphylococcus sp. HMSC068G11
  ref <308>: DATABASE ACCESSION NUMBER: NCBI ACCESSION: NZ_KV822091.1
  ref <309>: DATABASE ENTRY DATE: 2019-04-01
  ref <313>: RELEVANT RESIDUES IN SEQ ID NO: (1)..(1443)
gagtaacacgtggataacctacctataagactgggataacttcgggaaaccggagctaataccggataatatattgaaccgcatggttcaatagtgaaagacggttttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8913 - DNA, 970 bp, Staphylococcus sp. HMSC068G12
  ref <308>: DATABASE ACCESSION NUMBER: NCBI ACCESSION: NZ_KV811898.1
  ref <309>: DATABASE ENTRY DATE: 2019-04-01
  ref <313>: RELEVANT RESIDUES IN SEQ ID NO: (1)..(970)
ctctgacgttagcggcggacgggtgagtaacacgtggataacctacctataagactgggataacttcgggaaaccggagctaataccggataatatattgaaccgcatggttcaatagtgaaagacggttttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacagg

SEQ ID NO: 8914 - DNA, 1556 bp, Staphylococcus sp. HMSC068H08; identical to SEQ ID NO: 8880
  ref <308>: DATABASE ACCESSION NUMBER: NCBI ACCESSION: NZ_KV818357.1
  ref <309>: DATABASE ENTRY DATE: 2019-04-01
  ref <313>: RELEVANT RESIDUES IN SEQ ID NO: (1)..(1556)

SEQ ID NO: 8915 - DNA, 1557 bp, Staphylococcus sp. HMSC068H12
  ref <308>: DATABASE ACCESSION NUMBER: NCBI ACCESSION: NZ_KV806871.1
  ref <309>: DATABASE ENTRY DATE: 2019-04-01
  ref <313>: RELEVANT RESIDUES IN SEQ ID NO: (1)..(1557)
tttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactgggataacttcgggaaaccggagctaataccggataacatttggaaccgcatggttctaaagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaagggtttcggctcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaaaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaaggtagccgtatcggaaggtgcggctggatcacctcctttctaa

SEQ ID NO: 8916 - DNA, 918 bp, Staphylococcus sp. HMSC069D04
  ref <308>: DATABASE ACCESSION NUMBER: NCBI ACCESSION: NZ_KV832543.1
  ref <309>: DATABASE ENTRY DATE: 2019-04-01
  ref <313>: RELEVANT RESIDUES IN SEQ ID NO: (1)..(918)
cattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaagga

SEQ ID NO: 8917 - DNA, 950 bp, Staphylococcus sp. HMSC069D07
  ref <308>: DATABASE ACCESSION NUMBER: NCBI ACCESSION: NZ_KV800407.1
  ref <309>: DATABASE ENTRY DATE: 2019-04-01
  ref <313>: RELEVANT RESIDUES IN SEQ ID NO: (1)..(950)
gagtaacacgtgggtaacctacctataagactgggataacttcgggaaaccggagctaataccggataatatttcgaaccgcatggttcgatagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatacgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcggggggacaaagtgacaggtgg

SEQ ID NO: 8918 - DNA, 1556 bp, Staphylococcus sp. HMSC069D12; identical to SEQ ID NO: 8895
  ref <308>: DATABASE ACCESSION NUMBER: NCBI ACCESSION: NZ_KV801113.1
  ref <309>: DATABASE ENTRY DATE: 2019-04-01
  ref <313>: RELEVANT RESIDUES IN SEQ ID NO: (1)..(1556)

SEQ ID NO: 8919 - DNA, 1556 bp, Staphylococcus sp. HMSC069E07; identical to SEQ ID NO: 8852
  ref <308>: DATABASE ACCESSION NUMBER: NCBI ACCESSION: NZ_KV832651.1
  ref <309>: DATABASE ENTRY DATE: 2019-04-01
  ref <313>: RELEVANT RESIDUES IN SEQ ID NO: (1)..(1556)

SEQ ID NO: 8920 - DNA, 950 bp, Staphylococcus sp. HMSC069E10
  ref <308>: DATABASE ACCESSION NUMBER: NCBI ACCESSION: NZ_KV796509.1
  ref <309>: DATABASE ENTRY DATE: 2019-04-01
  ref <313>: RELEVANT RESIDUES IN SEQ ID NO: (1)..(950)
gttagcggcggacgggtgagtaacacgtaggtaacctacctataagactgggataacttcgggaaaccggagctaataccggataatatttcgaaccgcatggttcgatagtgaaagatggctttgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcggggg

SEQ ID NO: 8921 - DNA, 1460 bp, Staphylococcus sp. HMSC06C11; identical to SEQ ID NO: 8839
  ref <308>: DATABASE ACCESSION NUMBER: NCBI ACCESSION: NZ_KV793050.1
  ref <309>: DATABASE ENTRY DATE: 2019-04-01
  ref <313>: RELEVANT RESIDUES IN SEQ ID NO: (1)..(1460)

SEQ ID NO: 8922 - DNA, 1447 bp, Staphylococcus sp. HMSC070A02
  ref <308>: DATABASE ACCESSION NUMBER: NCBI ACCESSION: NZ_KV837298.1
  ref <309>: DATABASE ENTRY DATE: 2019-04-01
  ref <313>: RELEVANT RESIDUES IN SEQ ID NO: (1)..(1447)
gagtaacacgtgggtaacctacctataagactgggataactccgggaaaccggggctaataccggataacacatgaaaccgcatggtttcatgatgaaagacggttttgctgtcacttatagatggacccgcggcgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaggatgtaagtaactatgcaccccttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacggtacaaagggcagcgaacccgcgaggtcaagcaaatcccataaagccgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggaactagccgtcgaaggtgggacaaatgattggggtgaagtcgtaacaaggtagccgtatcggaaggtgcggctggatcacctcctttctaagga

SEQ ID NO: 8923 - DNA, 1555 bp, Staphylococcus sp. HMSC070A03
  ref <308>: DATABASE ACCESSION NUMBER: NCBI ACCESSION: NZ_KV837398.1
  ref <309>: DATABASE ENTRY DATE: 2019-04-01
  ref <313>: RELEVANT RESIDUES IN SEQ ID NO: (1)..(1555)
ttatggagagtttgatcctggctcaggatgaacgctggcggcgtgcctaatacatgcaagtcgagcgaacagacgaggagcttgctcctctgacgttagcggcggacgggtgagtaacacgtgggtaacctacctataagactgggataactccgggaaaccggggctaataccggataacacatgaaaccgcatggtttcatgatgaaagacggttttgctgtcacttatagatggacccgcggcgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaggatgtaagtaactgtgcatcccttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacggtacaaagggcagcgaacccgcgaggtcaagcaaatcccataaagccgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggaactagccgtcgaaggtgggacaaatgattggggtgaagtcgtaacaaggtagccgtatcggaaggtgcggctggatcacctcctttctaa

SEQ ID NO: 8924 - DNA, 1556 bp, Staphylococcus sp. HMSC070A07; identical to SEQ ID NO: 8837
  ref <308>: DATABASE ACCESSION NUMBER: NCBI ACCESSION: NZ_KV832803.1
  ref <309>: DATABASE ENTRY DATE: 2019-04-01
  ref <313>: RELEVANT RESIDUES IN SEQ ID NO: (1)..(1556)

SEQ ID NO: 8925 - DNA, 1556 bp, Staphylococcus sp. HMSC070D05
  ref <308>: DATABASE ACCESSION NUMBER: NCBI ACCESSION: NZ_KV821106.1
  ref <309>: DATABASE ENTRY DATE: 2019-04-01
  ref <313>: RELEVANT RESIDUES IN SEQ ID NO: (1)..(1556)
ttttatggagagtttgatcctggctcaggatgaacgctggcggcgtgcctaatacatgcaagtcgagcgaacagatgaggagcttgctcctttgatgttagcggcggacgggtgagtaacacgtgggtaacctacctataagactgggataacttcgggaaaccggagctaataccggataatatttcgaaccgcatggttcgatagtgaaagatggctctgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8926 - DNA, 1446 bp, Staphylococcus sp. HMSC070D07; identical to SEQ ID NO: 8877
  ref <308>: DATABASE ACCESSION NUMBER: NCBI ACCESSION: NZ_KV832933.1
  ref <309>: DATABASE ENTRY DATE: 2019-04-01
  ref <313>: RELEVANT RESIDUES IN SEQ ID NO: (1)..(1446)

SEQ ID NO: 8927 - DNA, 550 bp, Staphylococcus sp. HMSC071G07
  ref <308>: DATABASE ACCESSION NUMBER: NCBI ACCESSION: NZ_KV804764.1
  ref <309>: DATABASE ENTRY DATE: 2019-04-01
  ref <313>: RELEVANT RESIDUES IN SEQ ID NO: (1)..(550)
atccctctagagatagagttttccccttcgggggacaaagtgacaggtggtgcatggttgtcgtcagctcgtgtcgtgagatgttgggttaagtcccgcaacgagcgcaacccttaagcttagttgccatcattcagttgggcactctaagttgactgccggtgacaaaccggaggaaggtggggatgacgtcaaatcatcatgccccttatgatttgggctacacacgtgctacaatggacaatacaaagggcagctaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagcaaccactttgtggagctagccgtcgaaggtgggacaaatgattggggtgaagtcgtaacaaggtagccgtatcggaaggtgcggctggatcacctcctttctaagga

SEQ ID NO: 8928 - DNA, 1555 bp, Staphylococcus sp. HMSC072B07
  ref <308>: DATABASE ACCESSION NUMBER: NCBI ACCESSION: NZ_KV820926.1
  ref <309>: DATABASE ENTRY DATE: 2019-04-01
  ref <313>: RELEVANT RESIDUES IN SEQ ID NO: (1)..(1555)
ttatggagagtttgatcctggctcaggatgaacgctggcggcgtgcctaatacatgcaagtcgagcgaacagacgaggagcttgctcctctgacgttagcggcggacgggtgagtaacacgtgggtaacctacctataagactgggataactccgggaaaccggggctaataccggataacacatgaaaccgcatggtttcatgatgaaagacggttttgctgtcacttatagatggacccgcggcgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaggatgtaagtaactgtgcatcccttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacggtacaaagggcagcgaacccgcgaggtcaagcaaatcccataaagccgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggaactagccgtcgaaggtgggacaaatgattggggtgaagtcgtaacaaggtagccgtatcggaaggtgcggctggatcacctcctttctaa

SEQ ID NO: 8929 - DNA, 1556 bp, Staphylococcus sp. HMSC072D04; identical to SEQ ID NO: 8852
  ref <308>: DATABASE ACCESSION NUMBER: NCBI ACCESSION: NZ_KV816134.1
  ref <309>: DATABASE ENTRY DATE: 2019-04-01
  ref <313>: RELEVANT RESIDUES IN SEQ ID NO: (1)..(1556)

SEQ ID NO: 8930 - DNA, 1529 bp, Staphylococcus sp. HMSC072E01
  ref <308>: DATABASE ACCESSION NUMBER: NCBI ACCESSION: NZ_KV814983.1
  ref <309>: DATABASE ENTRY DATE: 2019-04-01
  ref <313>: RELEVANT RESIDUES IN SEQ ID NO: (1)..(1529)
tatgagagtttgatcctggctcaggacgaacgctggcggcgtgcctaatacatgcaagtcgaacgcttctttcctcccgagtgcttgcactcaattggaaagaggagtggcggacgggtgagtaacacgtgggtaacctacccatcagagggggataacacttggaaacaggtgctaataccgcataacagtttatgccgcatggcataagagtgaaaggcgctttcgggtgtcgctgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggacgttagtaactgaacgtcccctgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgctagaccgcgaggtcatgcaaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgta

SEQ ID NO: 8931 - DNA, 1128 bp, Staphylococcus sp. HMSC072H01
  ref <308>: DATABASE ACCESSION NUMBER: NCBI ACCESSION: NZ_KV802204.1
  ref <309>: DATABASE ENTRY DATE: 2019-04-01
  ref <313>: RELEVANT RESIDUES IN SEQ ID NO: (1)..(1128)
ttttatggagagtttgatcctggctcaggatgaacgctggcggcgtgcctaatacatgcaagtcgagcgaacagacgaggagcttgctcctctgacgttagcggcggacgggtgagtaacacgtggataacctacctataagactgggataacttcgggaaaccggagctaataccggataatatattgaaccgcatggttcaatagtgaaagacggttttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaaccctta

SEQ ID NO: 8932 - DNA, 1441 bp, Staphylococcus sp. HMSC072H03
  ref <308>: DATABASE ACCESSION NUMBER: NCBI ACCESSION: NZ_KV796868.1
  ref <309>: DATABASE ENTRY DATE: 2019-04-01
  ref <313>: RELEVANT RESIDUES IN SEQ ID NO: (1)..(1441)
gtaacacgtaggtaacctacctataagactgggataacttcgggaaaccggagctaataccggataatatttcgaaccgcatggttcgatagtgaaagatggctttgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8933 - DNA, 965 bp, Staphylococcus sp. HMSC073C02
  ref <308>: DATABASE ACCESSION NUMBER: NCBI ACCESSION: NZ_KV808909.1
  ref <309>: DATABASE ENTRY DATE: 2019-04-01
  ref <313>: RELEVANT RESIDUES IN SEQ ID NO: (1)..(965)
acgttagcggcggacgggtgagtaacacgtggataacctacctataagactgggataacttcgggaaaccggagctaataccggataatatattgaaccgcatggttcaatagtgaaagacggttttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacagg

SEQ ID NO: 8934 - DNA, 1556 bp, Staphylococcus sp. HMSC073C12; identical to SEQ ID NO: 8855
  ref <308>: DATABASE ACCESSION NUMBER: NCBI ACCESSION: NZ_KV814433.1
  ref <309>: DATABASE ENTRY DATE: 2019-04-01
  ref <313>: RELEVANT RESIDUES IN SEQ ID NO: (1)..(1556)

SEQ ID NO: 8935 - DNA, 1556 bp, Staphylococcus sp. HMSC073E10; identical to SEQ ID NO: 8837
  ref <308>: DATABASE ACCESSION NUMBER: NCBI ACCESSION: NZ_KV813204.1
  ref <309>: DATABASE ENTRY DATE: 2019-04-01
  ref <313>: RELEVANT RESIDUES IN SEQ ID NO: (1)..(1556)

SEQ ID NO: 8936 - DNA, 1505 bp, Staphylococcus sp. HMSC074A11
  ref <308>: DATABASE ACCESSION NUMBER: NCBI ACCESSION: NZ_KV800489.1
  ref <309>: DATABASE ENTRY DATE: 2019-04-01
  ref <313>: RELEVANT RESIDUES IN SEQ ID NO: (1)..(1505)
atacatgcaagtcgagcgaacagacaaggagcttgctcctttgacgttagcggcggacgggtgagtaacacgtgggtaacctacctataagactgggataacttcgggaaaccggagctaataccggataatatttcgaaccgcatggttcgatagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatacgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8937 - DNA, 1104 bp, Staphylococcus sp. HMSC074B09
  ref <308>: DATABASE ACCESSION NUMBER: NCBI ACCESSION: NZ_KV798621.1
  ref <309>: DATABASE ENTRY DATE: 2019-04-01
  ref <313>: RELEVANT RESIDUES IN SEQ ID NO: (1)..(1104)
gttagcggcggacgggtgagtaacacgtaggtaacctacctataagactgggataacttcgggaaaccggagctaataccggataatatttcgaaccgcatggttcgatagtgaaagatggctttgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatg

SEQ ID NO: 8938 - DNA, 436 bp, Staphylococcus sp. HMSC074C02
  ref <308>: DATABASE ACCESSION NUMBER: NCBI ACCESSION: NZ_KV800598.1
  ref <309>: DATABASE ENTRY DATE: 2019-04-01
  ref <313>: RELEVANT RESIDUES IN SEQ ID NO: (1)..(436)
gcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattgggg

SEQ ID NO: 8939 - DNA, 1556 bp, Staphylococcus sp. HMSC074C12; identical to SEQ ID NO: 8852
  ref <308>: DATABASE ACCESSION NUMBER: NCBI ACCESSION: NZ_KV834098.1
  ref <309>: DATABASE ENTRY DATE: 2019-04-01
  ref <313>: RELEVANT RESIDUES IN SEQ ID NO: (1)..(1556)

SEQ ID NO: 8940 - DNA, 848 bp, Staphylococcus sp. HMSC074D07
  ref <308>: DATABASE ACCESSION NUMBER: NCBI ACCESSION: NZ_KV834214.1
  ref <309>: DATABASE ENTRY DATE: 2019-04-01
  ref <313>: RELEVANT RESIDUES IN SEQ ID NO: (1)..(848)
ttttatggagagtttgatcctggctcaggatgaacgctggcggcgtgcctaatacatgcaagtcgagcgaacagacgaggagcttgctcctctgacgttagcggcggacgggtgagtaacacgtggataacctacctataagactgggataacttcgggaaaccggagctaataccggataatatattgaaccgcatggttcaatagtgaaagacggttttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttaggggg

SEQ ID NO: 8941 - DNA, 1556 bp, Staphylococcus sp. HMSC074F11; identical to SEQ ID NO: 8837
  ref <308>: DATABASE ACCESSION NUMBER: NCBI ACCESSION: NZ_KV834579.1
  ref <309>: DATABASE ENTRY DATE: 2019-04-01
  ref <313>: RELEVANT RESIDUES IN SEQ ID NO: (1)..(1556)

SEQ ID NO: 8942 - DNA, 1046 bp, Staphylococcus sp. HMSC075A04; identical to SEQ ID NO: 8840
  ref <308>: DATABASE ACCESSION NUMBER: NCBI ACCESSION: NZ_KV801348.1
  ref <309>: DATABASE ENTRY DATE: 2019-04-01
  ref <313>: RELEVANT RESIDUES IN SEQ ID NO: (1)..(1046)

SEQ ID NO: 8943 - DNA, 1557 bp, Staphylococcus sp. HMSC075C08; identical to SEQ ID NO: 8834
  ref <308>: DATABASE ACCESSION NUMBER: NCBI ACCESSION: NZ_KV803105.1
  ref <309>: DATABASE ENTRY DATE: 2019-04-01
  ref <313>: RELEVANT RESIDUES IN SEQ ID NO: (1)..(1557)

SEQ ID NO: 8944 - DNA, 1556 bp, Staphylococcus sp. HMSC075F12; identical to SEQ ID NO: 8852
  ref <308>: DATABASE ACCESSION NUMBER: NCBI ACCESSION: NZ_KV814218.1
  ref <309>: DATABASE ENTRY DATE: 2019-04-01
  ref <313>: RELEVANT RESIDUES IN SEQ ID NO: (1)..(1556)

SEQ ID NO: 8945 - DNA, 1460 bp, Staphylococcus sp. HMSC075H09; identical to SEQ ID NO: 8835
  ref <308>: DATABASE ACCESSION NUMBER: NCBI ACCESSION: NZ_KV810341.1
  ref <309>: DATABASE ENTRY DATE: 2019-04-01
  ref <313>: RELEVANT RESIDUES IN SEQ ID NO: (1)..(1460)

SEQ ID NO: 8946 - DNA, 1556 bp, Staphylococcus sp. HMSC076B11; identical to SEQ ID NO: 8852
  ref <308>: DATABASE ACCESSION NUMBER: NCBI ACCESSION: NZ_KV799615.1
  ref <309>: DATABASE ENTRY DATE: 2019-04-01
  ref <313>: RELEVANT RESIDUES IN SEQ ID NO: (1)..(1556)

SEQ ID NO: 8947 - DNA, 1214 bp, Staphylococcus sp. HMSC076E07
  ref <308>: DATABASE ACCESSION NUMBER: NCBI ACCESSION: NZ_KV799742.1
  ref <309>: DATABASE ENTRY DATE: 2019-04-01
  ref <313>: RELEVANT RESIDUES IN SEQ ID NO: (1)..(1214)
actcctacgggaggcagcagtagggaatcttccgcaatgggcgaaagcctgacggagcaacgccgcgtgagtgatgaaggtcttcggatcgtaaaactctgttattagggaagaacatacgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaagga

SEQ ID NO: 8948 - DNA, 1467 bp, Staphylococcus sp. HMSC076H12; identical to SEQ ID NO: 8832
  ref <308>: DATABASE ACCESSION NUMBER: NCBI ACCESSION: NZ_KV814532.1
  ref <309>: DATABASE ENTRY DATE: 2019-04-01
  ref <313>: RELEVANT RESIDUES IN SEQ ID NO: (1)..(1467)

SEQ ID NO: 8949 - DNA, 1556 bp, Staphylococcus sp. HMSC077B09
  ref <308>: DATABASE ACCESSION NUMBER: NCBI ACCESSION: NZ_KV794365.1
  ref <309>: DATABASE ENTRY DATE: 2019-04-01
  ref <313>: RELEVANT RESIDUES IN SEQ ID NO: (1)..(1556)
ttttatggagagtttgatcctggctcaggatgaacgctggcggcgtgcctaatacatgcaagttgagcgaacagataaggagcttgctcctttgacgttagcggcggacgggtgagtaacacgtgggtaacctacctataagactgggataacttcgggaaaccggagctaataccggataatatttcgaaccgcatggttcgatagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8950 - DNA, 1467 bp, Staphylococcus sp. HMSC077C03; identical to SEQ ID NO: 8832
  ref <308>: DATABASE ACCESSION NUMBER: NCBI ACCESSION: NZ_KV834665.1
  ref <309>: DATABASE ENTRY DATE: 2019-04-01
  ref <313>: RELEVANT RESIDUES IN SEQ ID NO: (1)..(1467)

SEQ ID NO: 8951 - DNA, 1556 bp, Staphylococcus sp. HMSC077C04; identical to SEQ ID NO: 8855
  ref <308>: DATABASE ACCESSION NUMBER: NCBI ACCESSION: NZ_KV794596.1
  ref <309>: DATABASE ENTRY DATE: 2019-04-01
  ref <313>: RELEVANT RESIDUES IN SEQ ID NO: (1)..(1556)

SEQ ID NO: 8952 - DNA, 1556 bp, Staphylococcus sp. HMSC077D08; identical to SEQ ID NO: 8837
  ref <308>: DATABASE ACCESSION NUMBER: NCBI ACCESSION: NZ_KV834750.1
  ref <309>: DATABASE ENTRY DATE: 2019-04-01
  ref <313>: RELEVANT RESIDUES IN SEQ ID NO: (1)..(1556)

SEQ ID NO: 8953 - DNA, 1441 bp, Staphylococcus sp. HMSC077D09
  ref <308>: DATABASE ACCESSION NUMBER: NCBI ACCESSION: NZ_KV834845.1
  ref <309>: DATABASE ENTRY DATE: 2019-04-01
  ref <313>: RELEVANT RESIDUES IN SEQ ID NO: (1)..(1441)
gtaacacgtggataacctacctataagactgggataacttcgggaaaccggagctaataccggataatatattgaaccgcatggttcaatagtgaaagacggttttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaatcgcgaggtcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8954 - DNA, 1556 bp, Staphylococcus sp. HMSC077E11; identical to SEQ ID NO: 8858
  ref <308>: DATABASE ACCESSION NUMBER: NCBI ACCESSION: NZ_KV808833.1
  ref <309>: DATABASE ENTRY DATE: 2019-04-01
  ref <313>: RELEVANT RESIDUES IN SEQ ID NO: (1)..(1556)

SEQ ID NO: 8955 - DNA, 1556 bp, Staphylococcus sp. HMSC077E12; identical to SEQ ID NO: 8858
  ref <308>: DATABASE ACCESSION NUMBER: NCBI ACCESSION: NZ_KV799486.1
  ref <309>: DATABASE ENTRY DATE: 2019-04-01
  ref <313>: RELEVANT RESIDUES IN SEQ ID NO: (1)..(1556)

SEQ ID NO: 8956 - DNA, 750 bp, Staphylococcus sp. HMSC077G12
  ref <308>: DATABASE ACCESSION NUMBER: NCBI ACCESSION: NZ_KV834994.1
  ref <309>: DATABASE ENTRY DATE: 2019-04-01
  ref <313>: RELEVANT RESIDUES IN SEQ ID NO: (1)..(750)
gatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtgg

SEQ ID NO: 8957 - DNA, 716 bp, Staphylococcus sp. HMSC077H01
  ref <308>: DATABASE ACCESSION NUMBER: NCBI ACCESSION: NZ_KV835021.1
  ref <309>: DATABASE ENTRY DATE: 2019-04-01
  ref <313>: RELEVANT RESIDUES IN SEQ ID NO: (1)..(716)
gggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaagga

SEQ ID NO: 8958 - DNA, 1446 bp, Staphylococcus sp. HMSC078A03; identical to SEQ ID NO: 8873
  ref <308>: DATABASE ACCESSION NUMBER: NCBI ACCESSION: NZ_KV835539.1
  ref <309>: DATABASE ENTRY DATE: 2019-04-01
  ref <313>: RELEVANT RESIDUES IN SEQ ID NO: (1)..(1446)

SEQ ID NO: 8959 - DNA, 1276 bp, Staphylococcus sp. HMSC078A08
  ref <308>: DATABASE ACCESSION NUMBER: NCBI ACCESSION: NZ_KV835253.1
  ref <309>: DATABASE ENTRY DATE: 2019-04-01
  ref <313>: RELEVANT RESIDUES IN SEQ ID NO: (1)..(1276)
ttttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactgggataacttcgggaaaccggagctaataccggataatatttcgaaccgcatggttcgatagtgaaagatggttttgctatcacttatagatggacccgcgccgtattagctagttggtaaggtaacggctcaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaccg

SEQ ID NO: 8960 - DNA, 1555 bp, Staphylococcus sp. HMSC078A12
  ref <308>: DATABASE ACCESSION NUMBER: NCBI ACCESSION: NZ_KV835690.1
  ref <309>: DATABASE ENTRY DATE: 2019-04-01
  ref <313>: RELEVANT RESIDUES IN SEQ ID NO: (1)..(1555)
ttatggagagtttgatcctggctcaggatgaacgctggcggcgtgcctaatacatgcaagtcgagcgaacagacgaggagcttgctcctctgacgttagcggcggacgggtgagtaacacgtgggtaacctacctataagactgggataactccgggaaaccggggctaataccggataacacatgaaaccgcatggtttcatgatgaaagacggttttgctgtcacttatagatggacccgcggcgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaggatgtaagtaactatgcatcccttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacggtacaaagggcagcgaacccgcgaggtcaagcaaatcccataaagccgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggaactagccgtcgaaggtgggacaaatgattggggtgaagtcgtaacaaggtagccgtatcggaaggtgcggctggatcacctcctttctaa

SEQ ID NO: 8961 - DNA, 1446 bp, Staphylococcus sp. HMSC078B01; identical to SEQ ID NO: 8873
  ref <308>: DATABASE ACCESSION NUMBER: NCBI ACCESSION: NZ_KV818861.1
  ref <309>: DATABASE ENTRY DATE: 2019-04-01
  ref <313>: RELEVANT RESIDUES IN SEQ ID NO: (1)..(1446)

SEQ ID NO: 8962 - DNA, 1046 bp, Staphylococcus sp. HMSC078D05
  ref <308>: DATABASE ACCESSION NUMBER: NCBI ACCESSION: NZ_KV798225.1
  ref <309>: DATABASE ENTRY DATE: 2019-04-01
  ref <313>: RELEVANT RESIDUES IN SEQ ID NO: (1)..(1046)
ttttatggagagtttgatcctggctcaggatgaacgctggcggcgtgcctaatacatgcaagtcgagcgaacagacgaggagcttgctcctttgacgttagcggcggacgggtgagtaacacgtaggtaacctacctataagactgggataacttcgggaaaccggagctaataccggataatatttcgaaccgcatggttcgatagtgaaagatggctttgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcggggg

SEQ ID NO: 8963 - DNA, 1443 bp, Staphylococcus sp. HMSC078E07
  ref <308>: DATABASE ACCESSION NUMBER: NCBI ACCESSION: NZ_KV812147.1
  ref <309>: DATABASE ENTRY DATE: 2019-04-01
  ref <313>: RELEVANT RESIDUES IN SEQ ID NO: (1)..(1443)
gagtaacacgtaggtaacctacctataagactgggataacttcgggaaaccggagctaataccggataatatttcgaaccgcatggttcgatagtgaaagatggctttgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8964 - DNA, 1434 bp, Staphylococcus sp. HMSC10B09
  ref <308>: DATABASE ACCESSION NUMBER: NCBI ACCESSION: NZ_KV790884.1
  ref <309>: DATABASE ENTRY DATE: 2019-04-01
  ref <313>: RELEVANT RESIDUES IN SEQ ID NO: (1)..(1434)
agcgaacagacgaggagcttgctcctttgacgttagcggcggacgggtgagtaacacgtaggtaacctacctataagactgggataacttcgggaaaccggagctaataccggataatatttcgaaccgcatggttcgatagtgaaagatggctttgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattgggg

SEQ ID NO: 8965 - DNA, 1555 bp, Staphylococcus sp. HMSC10C03; identical to SEQ ID NO: 8923
  ref <308>: DATABASE ACCESSION NUMBER: NCBI ACCESSION: NZ_KV791064.1
  ref <309>: DATABASE ENTRY DATE: 2019-04-01
  ref <313>: RELEVANT RESIDUES IN SEQ ID NO: (1)..(1555)

SEQ ID NO: 8966 - DNA, 1099 bp, Staphylococcus sp. HMSC12H08; identical to SEQ ID NO: 8857
  ref <308>: DATABASE ACCESSION NUMBER: NCBI ACCESSION: NZ_KV791746.1
  ref <309>: DATABASE ENTRY DATE: 2019-04-01
  ref <313>: RELEVANT RESIDUES IN SEQ ID NO: (1)..(1099)

SEQ ID NO: 8967 - DNA, 1554 bp, Staphylococcus sp. HMSC13A10
  ref <308>: DATABASE ACCESSION NUMBER: NCBI ACCESSION: NZ_KV791862.1
  ref <309>: DATABASE ENTRY DATE: 2019-04-01
  ref <313>: RELEVANT RESIDUES IN SEQ ID NO: (1)..(1554)
tttaattgaagagtttgatcatggctcagattgaacgctggcggcaggcctaacacatgcaagtcgagcggtaacaggagaaagcttgctttcttgctgacgagcggcggacgggtgagtaatgtatggggatctgcccgatagagggggataactactggaaacggtggctaataccgcataatgtctacggaccaaagcaggggctcttcggaccttgcactatcggatgaacccatatgggattagctagtaggtggggtaaaggctcacctaggcgacgatctctagctggtctgagaggatgatcggccacactggaactgagacacggcccagactcctacgggaggcagcagtggggaatattgcacaatgggcgcaagcctgatgcagccatgccgcgtgtatgaagaaggccttagggttgtaaagtactttcagcggggaggaaggtgataaggttaatacccttatcaattgacgttacccgcagaagaagcaccggctaactccgtgccagcagccgcggtaatacggagggtgcaagcgttaatcggaattactgggcgtaaagcgcacgcaggcggtcaattaagtcagatgtgaaagccccgagcttaacttgggaattgcatctgaaactggttggctagagtcttgtagaggggggtagaattccatgtgtagcggtgaaatgcgtagagatgtggaggaataccggtggcgaaggcggccccctggacaaagactgacgctcaggcgcgaaagcgtggggatcaaacaggattagataccctggtagtccacgctgtaaacgatgtcgatttagaggttgtggtcttgaaccgtggcttctggagctaacgcgttaaatcgaccgcctggggagtacggccgcaaggttaaaactcaaatgaattgacggggacccgcacaagcggtggagcatgtggtttaattcgatgcaacgcgaagaaccttacctactcttgacatccagcgaatcctttagagatagaggagtgccttcgggaacgctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagcatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaagaga

SEQ ID NO: 8968 - DNA, 1427 bp, Staphylococcus sp. HMSC14C01
  ref <308>: DATABASE ACCESSION NUMBER: NCBI ACCESSION: NZ_KV792045.1
  ref <309>: DATABASE ENTRY DATE: 2019-04-01
  ref <313>: RELEVANT RESIDUES IN SEQ ID NO: (1)..(1427)
gagtaacacgtaggtaacctacctataagactgggataacttcgggaaaccggagctaataccggataatatttcgaaccgcatggttcgatagtgaaagatggctttgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctgg

SEQ ID NO: 8969 - DNA, 1556 bp, Staphylococcus sp. HMSC14C08
  ref <308>: DATABASE ACCESSION NUMBER: NCBI ACCESSION: NZ_KV792101.1
  ref <309>: DATABASE ENTRY DATE: 2019-04-01
  ref <313>: RELEVANT RESIDUES IN SEQ ID NO: (1)..(1556)
ttttatggagagtttgatcctggctcaggatgaacgctggcggcgtgcctaatacatgcaagtcgagcgaacagacaaggagcttgctcctttgacgttagcggcggacgggtgagtaacacgtgggtaacctacctataagactgggataacttcgggaaaccggagctaataccggataatatttcgaaccgcatggttcgatagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatacgtgtaagtaactatgcacgtcttgacggtgcctaatcagaaagccacggctaactacgtgccagcagccgcggtaatacgtaggtggcaagcgttatccggaattattgggagtaaagcgcgcgaaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccctaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8970 - DNA, 972 bp, Staphylococcus sp. HMSC14D01
  ref <308>: DATABASE ACCESSION NUMBER: NCBI ACCESSION: NZ_KV792146.1
  ref <309>: DATABASE ENTRY DATE: 2019-04-01
  ref <313>: RELEVANT RESIDUES IN SEQ ID NO: (1)..(972)
ttttatggagagtttgatcctggctcaggatgaacgctggcggcgtgcctaatacatgcaagtcgagcgaacagacaaggagcttgctcctttgacgttagcggcggacgggtgagtaacacgtgggtaacctacctataagactgggataacttcgggaaaccggagctaataccggataatatttcgaaccgcatggttcgatagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatacgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcccaagcggtggggcatgtggtttaattcg

SEQ ID NO: 8971 - DNA, 1427 bp, Staphylococcus sp. HMSC14D10
  ref <308>: DATABASE ACCESSION NUMBER: NCBI ACCESSION: NZ_KV792232.1
  ref <309>: DATABASE ENTRY DATE: 2019-04-01
  ref <313>: RELEVANT RESIDUES IN SEQ ID NO: (1)..(1427)
gagtaacacgtgggtaacctacctataagactgggataacttcgggaaaccggagctaataccggataatatttcgaaccgcatggttcgatagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctgg

SEQ ID NO: 8972 - DNA, 1556 bp, Staphylococcus sp. HMSC34B12; identical to SEQ ID NO: 8880
  ref <308>: DATABASE ACCESSION NUMBER: NCBI ACCESSION: NZ_KV838166.1
  ref <309>: DATABASE ENTRY DATE: 2019-04-01
  ref <313>: RELEVANT RESIDUES IN SEQ ID NO: (1)..(1556)

SEQ ID NO: 8973 - DNA, 1556 bp, Staphylococcus sp. HMSC34C02
  ref <308>: DATABASE ACCESSION NUMBER: NCBI ACCESSION: NZ_KV838551.1
  ref <309>: DATABASE ENTRY DATE: 2019-04-01
  ref <313>: RELEVANT RESIDUES IN SEQ ID NO: (1)..(1556)
ttttatggagagtttgatcctggctcaggatgaacgctggcggcgtgcctaatacatgcaagtcgagcgaacagacaaggagcttgctcctttgacgttagcggcggacgggtgagtaacacgtgggtaacctacctataagactgggataacttcgggaaaccggagctaataccggataatatttcgaaccgcatggttcgatagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 8974 - DNA, 1557 bp, Staphylococcus sp. HMSC34D01; identical to SEQ ID NO: 8834
  ref <308>: DATABASE ACCESSION NUMBER: NCBI ACCESSION: NZ_KV838612.1
  ref <309>: DATABASE ENTRY DATE: 2019-04-01
  ref <313>: RELEVANT RESIDUES IN SEQ ID NO: (1)..(1557)

SEQ ID NO: 8975 - DNA, 1060 bp, Staphylococcus sp. HMSC34G04
  ref <308>: DATABASE ACCESSION NUMBER: NCBI ACCESSION: NZ_KV838760.1
  ref <309>: DATABASE ENTRY DATE: 2019-04-01
  ref <313>: RELEVANT RESIDUES IN SEQ ID NO: (1)..(1060)
atcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaagga

SEQ ID NO: 8976 - DNA, 1557 bp, Staphylococcus sp. HMSC34H10; identical to SEQ ID NO: 8834
  ref <308>: DATABASE ACCESSION NUMBER: NCBI ACCESSION: NZ_KV838839.1
  ref <309>: DATABASE ENTRY DATE: 2019-04-01
  ref <313>: RELEVANT RESIDUES IN SEQ ID NO: (1)..(1557)

SEQ ID NO: 8977 - DNA, 1557 bp, Staphylococcus sp. HMSC35D08; identical to SEQ ID NO: 8850
  ref <308>: DATABASE ACCESSION NUMBER: NCBI ACCESSION: NZ_KV838927.1
  ref <309>: DATABASE ENTRY DATE: 2019-04-01
  ref <313>: RELEVANT RESIDUES IN SEQ ID NO: (1)..(1557)

SEQ ID NO: 8978 - DNA, 1556 bp, Staphylococcus sp. HMSC36A02; identical to SEQ ID NO: 8880
  ref <308>: DATABASE ACCESSION NUMBER: NCBI ACCESSION: NZ_KV839004.1
  ref <309>: DATABASE ENTRY DATE: 2019-04-01
  ref <313>: RELEVANT RESIDUES IN SEQ ID NO: (1)..(1556)

SEQ ID NO: 8979 - DNA, 1557 bp, Staphylococcus sp. HMSC36A10; identical to SEQ ID NO: 8850
  ref <308>: DATABASE ACCESSION NUMBER: NCBI ACCESSION: NZ_KV839066.1
  ref <309>: DATABASE ENTRY DATE: 2019-04-01
  ref <313>: RELEVANT RESIDUES IN SEQ ID NO: (1)..(1557)

SEQ ID NO: 8980 - DNA, 1557 bp, Staphylococcus sp. HMSC36C03; identical to SEQ ID NO: 8850
  ref <308>: DATABASE ACCESSION NUMBER: NCBI ACCESSION: NZ_KV839172.1
  ref <309>: DATABASE ENTRY DATE: 2019-04-01
  ref <313>: RELEVANT RESIDUES IN SEQ ID NO: (1)..(1557)

SEQ ID NO: 8981 - DNA, 1557 bp, Staphylococcus sp. HMSC36D07; identical to SEQ ID NO: 8834
  ref <308>: DATABASE ACCESSION NUMBER: NCBI ACCESSION: NZ_KV839230.1
  ref <309>: DATABASE ENTRY DATE: 2019-04-01
  ref <313>: RELEVANT RESIDUES IN SEQ ID NO: (1)..(1557)

SEQ ID NO: 8982 - DNA, 1557 bp, Staphylococcus sp. HMSC36D12; identical to SEQ ID NO: 8834
  ref <308>: DATABASE ACCESSION NUMBER: NCBI ACCESSION: NZ_KV839321.1
  ref <309>: DATABASE ENTRY DATE: 2019-04-01
  ref <313>: RELEVANT RESIDUES IN SEQ ID NO: (1)..(1557)

SEQ ID NO: 8983 - DNA, 1557 bp, Staphylococcus sp. HMSC36F05; identical to SEQ ID NO: 8834
  ref <308>: DATABASE ACCESSION NUMBER: NCBI ACCESSION: NZ_KV839399.1
  ref <309>: DATABASE ENTRY DATE: 2019-04-01
  ref <313>: RELEVANT RESIDUES IN SEQ ID NO: (1)..(1557)

SEQ ID NO: 8984 - DNA, 1470 bp, Staphylococcus sp. HMSC36G04
  ref <308>: DATABASE ACCESSION NUMBER: NCBI ACCESSION: NZ_KV839483.1
  ref <309>: DATABASE ENTRY DATE: 2019-04-01
  ref <313>: RELEVANT RESIDUES IN SEQ ID NO: (1)..(1470)
tctgatgttagcggcggacgggtgagtaacacgtggataacctacctataagactgggataacttcgggaaaccggagctaataccggataatattttgaaccgcatggttcaaaagtgaaagacggtcttgctgtcacttatagatggatccgcgctgcattagctagttggtaaggtaacggcttaccaaggcaacgatgcatagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatatgtgtaagtaactgtgcacatcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacaaatgattggggtgaagtcgtaacaaggtagccgtatcggaaggtgcggctggatcacctcctttctaagga

SEQ ID NO: 8985 - DNA, 1556 bp, Staphylococcus sp. HMSC55D02; identical to SEQ ID NO: 8881
  ref <308>: DATABASE ACCESSION NUMBER: NCBI ACCESSION: NZ_KV839513.1
  ref <309>: DATABASE ENTRY DATE: 2019-04-01
  ref <313>: RELEVANT RESIDUES IN SEQ ID NO: (1)..(1556)

SEQ ID NO: 8986 - DNA, 1046 bp, Staphylococcus sp. HMSC55F09
  ref <308>: DATABASE ACCESSION NUMBER: NCBI ACCESSION: NZ_KV839564.1
  ref <309>: DATABASE ENTRY DATE: 2019-04-01
  ref <313>: RELEVANT RESIDUES IN SEQ ID NO: (1)..(1046)
ttttatggagagtttgatcctggctcaggatgaacgctggcggcgtgcctaatacatgcaagtcgagcgaacggacgagaagcttgcttctctgatgttagcggcggacgggtgagtaacacgtggataacctacctataagactgggataacttcgggaaaccggagctaataccggataatattttgaaccgcatggttcaaaagtgaaagacggtcttgctgtcacttatagatggatccgcgctgcattagctagttggtaaggtaacggcttaccaaggcaacgatgcatagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatatgtgtaagtaactgtgcacatcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcggggg

SEQ ID NO: 8987 - DNA, 1557 bp, Staphylococcus sp. HMSC56B09; identical to SEQ ID NO: 8850
  ref <308>: DATABASE ACCESSION NUMBER: NCBI ACCESSION: NZ_KV839686.1
  ref <309>: DATABASE ENTRY DATE: 2019-04-01
  ref <313>: RELEVANT RESIDUES IN SEQ ID NO: (1)..(1557)

SEQ ID NO: 8988 - DNA, 1557 bp, Staphylococcus sp. HMSC57A07; identical to SEQ ID NO: 8834
  ref <308>: DATABASE ACCESSION NUMBER: NCBI ACCESSION: NZ_KV839815.1
  ref <309>: DATABASE ENTRY DATE: 2019-04-01
  ref <313>: RELEVANT RESIDUES IN SEQ ID NO: (1)..(1557)

SEQ ID NO: 8989 - DNA, 1557 bp, Staphylococcus sp. HMSC57B03; identical to SEQ ID NO: 8834
  ref <308>: DATABASE ACCESSION NUMBER: NCBI ACCESSION: NZ_KV839718.1
  ref <309>: DATABASE ENTRY DATE: 2019-04-01
  ref <313>: RELEVANT RESIDUES IN SEQ ID NO: (1)..(1557)

SEQ ID NO: 8990 - DNA, 1470 bp, Staphylococcus sp. HMSC58A02; identical to SEQ ID NO: 8984
  ref <308>: DATABASE ACCESSION NUMBER: NCBI ACCESSION: NZ_KV839912.1
  ref <309>: DATABASE ENTRY DATE: 2019-04-01
  ref <313>: RELEVANT RESIDUES IN SEQ ID NO: (1)..(1470)

SEQ ID NO: 8991 - DNA, 1557 bp, Staphylococcus sp. HMSC58B01; identical to SEQ ID NO: 8850
  ref <308>: DATABASE ACCESSION NUMBER: NCBI ACCESSION: NZ_KV822153.1
  ref <309>: DATABASE ENTRY DATE: 2019-04-01
  ref <313>: RELEVANT RESIDUES IN SEQ ID NO: (1)..(1557)

SEQ ID NO: 8992 - DNA, 1557 bp, Staphylococcus sp. HMSC58E11; identical to SEQ ID NO: 8834
  ref <308>: DATABASE ACCESSION NUMBER: NCBI ACCESSION: NZ_KV839953.1
  ref <309>: DATABASE ENTRY DATE: 2019-04-01
  ref <313>: RELEVANT RESIDUES IN SEQ ID NO: (1)..(1557)

SEQ ID NO: 8993 - DNA, 505 bp, Staphylococcus sp. HMSC62A08
  ref <308>: DATABASE ACCESSION NUMBER: NCBI ACCESSION: NZ_KV840067.1
  ref <309>: DATABASE ENTRY DATE: 2019-04-01
  ref <313>: RELEVANT RESIDUES IN SEQ ID NO: (1)..(505)
taacatgttgaaccgcatggttcaacagtgaaagacggtcttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaa

SEQ ID NO: 8994 - DNA, 1055 bp, Staphylococcus sp. HMSC62B09
  ref <308>: DATABASE ACCESSION NUMBER: NCBI ACCESSION: NZ_KV840122.1
  ref <309>: DATABASE ENTRY DATE: 2019-04-01
  ref <313>: RELEVANT RESIDUES IN SEQ ID NO: (1)..(1055)
aaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagctttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaagga

SEQ ID NO: 8995 - DNA, 1356 bp, Staphylococcus sp. HMSC62D11
  ref <308>: DATABASE ACCESSION NUMBER: NCBI ACCESSION: NZ_KV840194.1
  ref <309>: DATABASE ENTRY DATE: 2019-04-01
  ref <313>: RELEVANT RESIDUES IN SEQ ID NO: (1)..(1356)
gagtaacacgtgggtaacctacctataagactgggacaacttcgggaaaccggagctaataccggataatatgttgaaccgcatggttcaatagtgaaagatggttttgctatcacttatagatggacccgcgccgtattagctagttggtgaggtaacggctcaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttaggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcatttagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagct

SEQ ID NO: 8996 - DNA, 1557 bp, Staphylococcus sp. HMSC64F10; identical to SEQ ID NO: 8834
  ref <308>: DATABASE ACCESSION NUMBER: NCBI ACCESSION: NZ_KV840217.1
  ref <309>: DATABASE ENTRY DATE: 2019-04-01
  ref <313>: RELEVANT RESIDUES IN SEQ ID NO: (1)..(1557)

SEQ ID NO: 8997 - DNA, 1555 bp, Staphylococcus sp. HMSC65H10
  ref <308>: DATABASE ACCESSION NUMBER: NCBI ACCESSION: NZ_KV840349.1
  ref <309>: DATABASE ENTRY DATE: 2019-04-01
  ref <313>: RELEVANT RESIDUES IN SEQ ID NO: (1)..(1555)
ttatggagagtttgatcctggctcaggatgaacgctggcggcgtgcctaatacatgcaagtcgagcgaacagacgaggagcttgctcctctgacgttagcggcggacgggtgagtaacacgtgggtaacctacctataagactgggataactccgggaaaccggggctaataccggataacacatgaaaccgcatggtttcatgatgaaagacggttttgctgtcacttatagatggacccgcggcgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaggatgtaagtaactatgcatcccttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacggtacaaagggcagcgaacccgcgaggtcaagcaaatcccataaagccgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggaactagccgtcgaaggtgggacaaatgattggggtgaagtcgtaacaaggtagccgtatcggaaggtgcggctggatcacctcctttctaa

SEQ ID NO: 8998 - DNA, 1557 bp, Staphylococcus sp. HMSC66A04; identical to SEQ ID NO: 8834
  ref <308>: DATABASE ACCESSION NUMBER: NCBI ACCESSION: NZ_KV840493.1
  ref <309>: DATABASE ENTRY DATE: 2019-04-01
  ref <313>: RELEVANT RESIDUES IN SEQ ID NO: (1)..(1557)

SEQ ID NO: 8999 - DNA, 1557 bp, Staphylococcus sp. HMSC66C11; identical to SEQ ID NO: 8834
  ref <308>: DATABASE ACCESSION NUMBER: NCBI ACCESSION: NZ_KV840570.1
  ref <309>: DATABASE ENTRY DATE: 2019-04-01
  ref <313>: RELEVANT RESIDUES IN SEQ ID NO: (1)..(1557)

SEQ ID NO: 9000 - DNA, 777 bp, Staphylococcus sp. HMSC69H07
  ref <308>: DATABASE ACCESSION NUMBER: NCBI ACCESSION: NZ_KV840650.1
  ref <309>: DATABASE ENTRY DATE: 2019-04-01
  ref <313>: RELEVANT RESIDUES IN SEQ ID NO: (1)..(777)
agttggtgaggtaacggctcaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttaggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagtctt

SEQ ID NO: 9001 - DNA, 1556 bp, Staphylococcus sp. HMSC70A05; identical to SEQ ID NO: 8855
  ref <308>: DATABASE ACCESSION NUMBER: NCBI ACCESSION: NZ_KV840791.1
  ref <309>: DATABASE ENTRY DATE: 2019-04-01
  ref <313>: RELEVANT RESIDUES IN SEQ ID NO: (1)..(1556)

SEQ ID NO: 9002 - DNA, 592 bp, Staphylococcus sp. HMSC70F07
  ref <308>: DATABASE ACCESSION NUMBER: NCBI ACCESSION: NZ_KV840723.1
  ref <309>: DATABASE ENTRY DATE: 2019-04-01
  ref <313>: RELEVANT RESIDUES IN SEQ ID NO: (1)..(592)
tcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatatgtgtaagtaactgtgcacatcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgacc

SEQ ID NO: 9003 - DNA, 1557 bp, Staphylococcus sp. HMSC72E08; identical to SEQ ID NO: 8834
  ref <308>: DATABASE ACCESSION NUMBER: NCBI ACCESSION: NZ_KV840757.1
  ref <309>: DATABASE ENTRY DATE: 2019-04-01
  ref <313>: RELEVANT RESIDUES IN SEQ ID NO: (1)..(1557)

SEQ ID NO: 9004 - DNA, 1557 bp, Staphylococcus sp. HMSC73A05; identical to SEQ ID NO: 8834
  ref <308>: DATABASE ACCESSION NUMBER: NCBI ACCESSION: NZ_KV840883.1
  ref <309>: DATABASE ENTRY DATE: 2019-04-01
  ref <313>: RELEVANT RESIDUES IN SEQ ID NO: (1)..(1557)

SEQ ID NO: 9005 - DNA, 1460 bp, Staphylococcus sp. HMSC73C01
  ref <308>: DATABASE ACCESSION NUMBER: NCBI ACCESSION: NZ_KV840964.1
  ref <309>: DATABASE ENTRY DATE: 2019-04-01
  ref <313>: RELEVANT RESIDUES IN SEQ ID NO: (1)..(1460)
gttagcggcggacgggtgagtaacacgtgggtaacctacctataagactgggacaacttcgggaaaccggagctaataccggataatatgttgaaccgcatggttcaatagtgaaagatggttttgctatcacttatagatggacccgcgccgtattagctagttggtgaggtaacggctcaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttaggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcatttagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaa

SEQ ID NO: 9006 - DNA, 1556 bp, Staphylococcus sp. HMSC74A08; identical to SEQ ID NO: 8855
  ref <308>: DATABASE ACCESSION NUMBER: NCBI ACCESSION: NZ_KV840932.1
  ref <309>: DATABASE ENTRY DATE: 2019-04-01
  ref <313>: RELEVANT RESIDUES IN SEQ ID NO: (1)..(1556)

SEQ ID NO: 9007 - DNA, 1557 bp, Staphylococcus sp. HMSC74D05; identical to SEQ ID NO: 8834
  ref <308>: DATABASE ACCESSION NUMBER: NCBI ACCESSION: NZ_KV841052.1
  ref <309>: DATABASE ENTRY DATE: 2019-04-01
  ref <313>: RELEVANT RESIDUES IN SEQ ID NO: (1)..(1557)

SEQ ID NO: 9008 - DNA, 901 bp, Staphylococcus sp. HMSC74F04
  ref <308>: DATABASE ACCESSION NUMBER: NCBI ACCESSION: NZ_KV841183.1
  ref <309>: DATABASE ENTRY DATE: 2019-04-01
  ref <313>: RELEVANT RESIDUES IN SEQ ID NO: (1)..(901)
ttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacaaatgattggggtgaagtcgtaacaaggtagccgtatcggaaggtgcggctggatcacctcctttctaagga

SEQ ID NO: 9009 - DNA, 1556 bp, Staphylococcus sp. HMSC74F12; identical to SEQ ID NO: 8881
  ref <308>: DATABASE ACCESSION NUMBER: NCBI ACCESSION: NZ_KV841235.1
  ref <309>: DATABASE ENTRY DATE: 2019-04-01
  ref <313>: RELEVANT RESIDUES IN SEQ ID NO: (1)..(1556)

SEQ ID NO: 9010 - DNA, 1557 bp, Staphylococcus sp. HMSC74G01; identical to SEQ ID NO: 8834
  ref <308>: DATABASE ACCESSION NUMBER: NCBI ACCESSION: NZ_KV841288.1
  ref <309>: DATABASE ENTRY DATE: 2019-04-01
  ref <313>: RELEVANT RESIDUES IN SEQ ID NO: (1)..(1557)

SEQ ID NO: 9011 - DNA, 1046 bp, Staphylococcus sp. HMSC74G05
  ref <308>: DATABASE ACCESSION NUMBER: NCBI ACCESSION: NZ_KV841351.1
  ref <309>: DATABASE ENTRY DATE: 2019-04-01
  ref <313>: RELEVANT RESIDUES IN SEQ ID NO: (1)..(1046)
ttttatggagagtttgatcctggctcaggatgaacgctggcggcgtgcctaatacatgcaagtcgagcgaacggacgagaagcttgcttctctgatgttagcggcggacgggtgagtaacacgtggataacctacctataagactgggataacttcgggaaaccggagctaataccggataatattttgaaccgcatggttcaaaagtgaaagacggtcttgctgtcacttatagatggatccgcgctgcattagctagttggtaaggtaacggcttaccaaggcaacgatgcatagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacatatgtgtaagtaactgtgcacatcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagctttccccttcggggg

SEQ ID NO: 9012 - DNA, 1557 bp, Staphylococcus sp. HMSC76G03; identical to SEQ ID NO: 8834
  ref <308>: DATABASE ACCESSION NUMBER: NCBI ACCESSION: NZ_KV841520.1
  ref <309>: DATABASE ENTRY DATE: 2019-04-01
  ref <313>: RELEVANT RESIDUES IN SEQ ID NO: (1)..(1557)

SEQ ID NO: 9013 - DNA, 1557 bp, Staphylococcus sp. HMSC77A05; identical to SEQ ID NO: 8834
  ref <308>: DATABASE ACCESSION NUMBER: NCBI ACCESSION: NZ_KV841435.1
  ref <309>: DATABASE ENTRY DATE: 2019-04-01
  ref <313>: RELEVANT RESIDUES IN SEQ ID NO: (1)..(1557)

SEQ ID NO: 9014 - DNA, 830 bp, Staphylococcus sp. LCT-H4
  ref <308>: DATABASE ACCESSION NUMBER: NCBI ACCESSION: NZ_MODY01000016.1
  ref <309>: DATABASE ENTRY DATE: 2019-04-01
  ref <313>: RELEVANT RESIDUES IN SEQ ID NO: (1)..(830)
atttatggagagtttgatcctggctcaggatgaacgctggcggcgtgcctaatacatgcaagtcgagcgaacggataaggagcttgctcctttgaagttagcggcggacgggtgagtaacacgtgggtaacctacctataagactggaataacttcgggaaaccggagctaatgccggataacatatagaaccgcatggttctatagtgaaagatggttttgctatcacttatagatggacccgcgccgtattagctagttggtaaggtaatggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggttttcggatcgtaaaactctgttattagggaagaacaaatgcgtaagtaactgtgcgcatcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatga

SEQ ID NO: 9015 - DNA, 1361 bp, Staphylococcus sp. M0480
  ref <308>: DATABASE ACCESSION NUMBER: NCBI ACCESSION: NZ_KK013425.1
  ref <309>: DATABASE ENTRY DATE: 2019-04-01
  ref <313>: RELEVANT RESIDUES IN SEQ ID NO: (1)..(1361)
ttttatggagagtttgatcctggctcaggatgaacgctggcggcgtgcctaatacatgcaagtcgagcgaacagacgaggagcttgctcctttgacgttagcggcggacgggtgagtaacacgtaggtaacctacctataagactgggataacttcgggaaaccggagctaataccggataatatttcgaaccgcatggttcgatagtgaaagatggctttgctatcacttatagatggacctgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaacgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaat

SEQ ID NO: 9016 - DNA, 1555 bp, Staphylococcus sp. M0911
  ref <308>: DATABASE ACCESSION NUMBER: NCBI ACCESSION: NZ_CP022881.1
  ref <309>: DATABASE ENTRY DATE: 2019-04-01
  ref <313>: RELEVANT RESIDUES IN SEQ ID NO: (1)..(1555)
tttatggagagtttgatcctggctcaggatgaacgctggcggcgtgcctaatacatgcaagtcgagcgaacagataaggagcttgctcctttgacgttagcggcggacgggtgagtaacacgtggataacctacctataagactgggataacttcgggaaaccggagctaataccggataacatattgaaccgcatggttcaatagtgaaaggcggctttgctgtcacttatagatggatccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttatcagggaagaacaaatgtgtaagtaactgtgcacatcttgacggtacctgatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagttttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagctaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaaggtagccgtatcggaaggtgcggctggatcacctcctttct

SEQ ID NO: 9017 - DNA, 1561 bp, Staphylococcus sp. MB371
  ref <308>: DATABASE ACCESSION NUMBER: NCBI ACCESSION: NZ_MRDD01000118.1
  ref <309>: DATABASE ENTRY DATE: 2019-04-01
  ref <313>: RELEVANT RESIDUES IN SEQ ID NO: (1)..(1561)
ttttatggagagtttgatcctggctcaggatgaacgctggcggcgtgcctaatacatgcaagtcgagcgaacagatgagaagcttgcttctctgatgttagcggcggacgggtgagtaacacgtgggtaacctacctataagactgggataactccgggaaaccggggctaataccggataatattttgaaccgcatggttcaatagtgaaagacggtttcggctgtcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttgttagggaagaacaaatttgttagtaactgaacaagtcttgacggtacctaaccagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggagagtggaattccatgtgtagcggtgaaatgcgcagagatatggaggaacaccagtggcgaaggcggctctctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacacgtgctacaatggataatacaaagggcagcgaatccgcgaggccaagcaaatcccataaaattattctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacaaatgattggggtgaagtcgtaacaaggtagccgtatcggaaggtgcggctggatcacctcctttctaagga

SEQ ID NO: 9018 - DNA, 1556 bp, Staphylococcus sp. MB377; identical to SEQ ID NO: 8895
  ref <308>: DATABASE ACCESSION NUMBER: NCBI ACCESSION: NZ_MAON01000025.1
  ref <309>: DATABASE ENTRY DATE: 2019-04-01
  ref <313>: RELEVANT RESIDUES IN SEQ ID NO: (1)..(1556)

SEQ ID NO: 9019 - DNA, 1384 bp, Staphylococcus sp. MDS7B
  ref <308>: DATABASE ACCESSION NUMBER: NCBI ACCESSION: NZ_AOTH01000276.1
  ref <309>: DATABASE ENTRY DATE: 2019-04-01
  ref <313>: RELEVANT RESIDUES IN SEQ ID NO: (1)..(1384)
ataccggataatatattgaaccgcatggttcaatagtgaaagacggttttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcttgacggagcaacgccgcgtgagtgatgaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactgaaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgatccctctagagatagaggtttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactatatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttcta

SEQ ID NO: 9020 - DNA, 1558 bp, Staphylococcus sp. NAM3COL9
  ref <308>: DATABASE ACCESSION NUMBER: NCBI ACCESSION: NZ_LGPC01000005.1
  ref <309>: DATABASE ENTRY DATE: 2019-04-01
  ref <313>: RELEVANT RESIDUES IN SEQ ID NO: (1)..(1558)
atttatggagagtttgatcctggctcaggatgaacgctggcggcgtgcctaatacatgcaagtcgagcgaacggataaggagcttgctcctttgaagttagcggcggacgggtgagtaacacgtgggtaacctacctataagactggaataacttcgggaaaccggagctaatgccggataacatttggaaccgcatggttctaaagtaaaagatggttttgctatcacttatagatggacccgcgccgtattagctagttggtaaggtaatggcttaccaaggcgacgatacgtagccgacctgagagggtgatcggccacactggaactgagacacggtccagactcctacgggaggcagcagtagggaatcttccgcaatggacgaaagtctgacggagcaacgccgcgtgagtgatgaaggttttcggatcgtaaaactctgttattagggaagaacaaatgtgtaagtaactgtgcacatcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtacagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaaaactctagagatagagccttccccttcgggggacaaagtgacaggtggtgcatggttgtcgtcagctcgtgtcgtgagatgttgggttaagtcccgcaacgagcgcaacccttaaacttagttgccagcatttagttgggcactctaggttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaaggtagccgtatcggaaggtgcggctggatcacctcctttctaa

SEQ ID NO: 9021 - DNA, 1071 bp, Staphylococcus sp. NFPP34
  ref <308>: DATABASE ACCESSION NUMBER: NCBI ACCESSION: NZ_FOBP01000034.1
  ref <309>: DATABASE ENTRY DATE: 2019-04-01
  ref <313>: RELEVANT RESIDUES IN SEQ ID NO: (1)..(1071)
gacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacccttctagagatagaagtttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttggagctagccgtcgaaggtgggacaaatgattggggtgaagtcgtaacaaggtagccgtatcggaaggtgcggctggatcacctcctttctaagga

SEQ ID NO: 9022 - DNA, 1558 bp, Staphylococcus sp. OJ82
  ref <308>: DATABASE ACCESSION NUMBER: NCBI ACCESSION: NZ_ALPU01000003.1
  ref <309>: DATABASE ENTRY DATE: 2019-04-01
  ref <313>: RELEVANT RESIDUES IN SEQ ID NO: (1)..(1558)
atttatggagagtttgatcctggctcaggatgaacgctggcggcgtgcctaatacatgcaagtcgagcgaacggataaggagcttgctcctttgaagttagcggcggacgggtgagtaacacgtgggtaacctacctataagactggaataacttcgggaaaccggagctaatgccggataacatttggaaccgcatggttctaaagtaaaagatggttttgctatcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatggacgaaagtctgacggagcaacgccgcgtgagtgatgaaggttttcggatcgtaaaactctgttattagggaagaacaaatgtgtaagtaactgtgcacatcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtacagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaaaactctagagatagagccttccccttcgggggacaaagtgacaggtggtgcatggttgtcgtcagctcgtgtcgtgagatgttgggttaagtcccgcaacgagcgcaacccttaaacttagttgccagcatttagttgggcactctaggttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaaggtagccgtatcggaaggtgcggctggatcacctcctttctaa

SEQ ID NO: 9023 - DNA, 1553 bp, Staphylococcus sp. RIT622
  ref <308>: DATABASE ACCESSION NUMBER: NCBI ACCESSION: NZ_SEMK01000027.1
  ref <309>: DATABASE ENTRY DATE: 2019-04-01
  ref <313>: RELEVANT RESIDUES IN SEQ ID NO: (1)..(1553)
tttatggagagtttgatcctggctcaggatgaacgctggcggcgtgcctaatacatgcaagtcgagcgaacagacgaggagcttgctcctctgacgttagcggcggacgggtgagtaacacgtggataacctacctataagactgggataacttcgggaaaccggagctaataccggataacatgttgaaccgcatggttcaacagtgaaagacggtcttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgaagaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgatccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttggagctagccgtcgaaggtgggacaaatgattggggtgaagtcgtaacaaggtagccgtatcggaaggtgcggctggatcacctcctttct

SEQ ID NO: 9024 - DNA, 1030 bp, Staphylococcus sp. S04009
  ref <308>: DATABASE ACCESSION NUMBER: NCBI ACCESSION: NZ_RCVN01000040.1
  ref <309>: DATABASE ENTRY DATE: 2019-04-01
  ref <313>: RELEVANT RESIDUES IN SEQ ID NO: (1)..(1030)
tttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactgggataacttcgggaaaccggagctaataccggataacatttggaaccgcatggttctaaagtgaaagatggttttgctatcacttatagatggacccgcgccgtattagctagttggtaaggtaacggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaagggtttcggctcgtaaaactctgttattagggaagaacaaatgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaaaactctagagatagagc

SEQ ID NO: 9025 - DNA, 1554 bp, Staphylococcus sp. SDB 2975
  ref <308>: DATABASE ACCESSION NUMBER: NCBI ACCESSION: NZ_CP033460.1
  ref <309>: DATABASE ENTRY DATE: 2019-04-01
  ref <313>: RELEVANT RESIDUES IN SEQ ID NO: (1)..(1554)
tttatggagagtttgatcctggctcaggatgaacgctggcggcgtgcctaatacatgcaagtcgagcgaacagacgaggagcttgctcctctgatgttagcggcggacgggtgagtaacacgtgggtaacctacctataagactggaataactccgggaaaccggggctaatgccggataatatgcggaaccgcatggttccgcaatgaaagacggttttgctgtcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaagtgcgtaggtaactatgcgcaccttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgcaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacagtacaaagggcagcgaaaccgcgaggtcaagcaaatcccataaagctgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttaggagctagccgtcgaaggtgggacgaatgattggggtgaagtcgtaacaaggtagccgtatcggaaggtgcggctggatcacctcctttct

SEQ ID NO: 9026 - DNA, 1555 bp, Staphylococcus sp. SNAZ 36
  ref <308>: DATABASE ACCESSION NUMBER: NCBI ACCESSION: NZ_SDRC01000044.1
  ref <309>: DATABASE ENTRY DATE: 2019-04-01
  ref <313>: RELEVANT RESIDUES IN SEQ ID NO: (1)..(1555)
tttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactggaataactccgggaaaccggggctaatgccggataacatttagaaccgcatggttctaaagtgaaagatggttttgctatcacttatagatggacccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagccttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaaggtagccgtatcggaaggtgcggctggatcacctcctttct

SEQ ID NO: 9027 - DNA, 1555 bp, Staphylococcus sp. SNAZ 59; identical to SEQ ID NO: 9026
  ref <308>: DATABASE ACCESSION NUMBER: NCBI ACCESSION: NZ_SDRD01000049.1
  ref <309>: DATABASE ENTRY DATE: 2019-04-01
  ref <313>: RELEVANT RESIDUES IN SEQ ID NO: (1)..(1555)

SEQ ID NO: 9028 - DNA, 1555 bp, Staphylococcus sp. SNAZ 75; identical to SEQ ID NO: 9026
  ref <308>: DATABASE ACCESSION NUMBER: NCBI ACCESSION: NZ_SDRE01000014.1
  ref <309>: DATABASE ENTRY DATE: 2019-04-01
  ref <313>: RELEVANT RESIDUES IN SEQ ID NO: (1)..(1555)

SEQ ID NO: 9029 - DNA, 1556 bp, Staphylococcus sp. TE8
  ref <308>: DATABASE ACCESSION NUMBER: NCBI ACCESSION: NZ_JMGB01000008.1
  ref <309>: DATABASE ENTRY DATE: 2019-04-01
  ref <313>: RELEVANT RESIDUES IN SEQ ID NO: (1)..(1556)
ttttatggagagtttgatcctggctcaggatgaacgctggcggcgtgcctaatacatgcaagtcgagcgaacagacgaggagcttgctcctctgacgttagcggcggacgggtgagtaacacgtggataacctacctataagactgggataacttcgggaaaccggagctaataccggataacatgttgaaccgcatggttcaacagtgaaagacggtcttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgaagaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttggagctagccgtcgaaggtgggacaaatgattggggtgaagtcgtaacaaggtagccgtatcggaaggtgcggctggatcacctcctttctaa

SEQ ID NO: 9030 - DNA, 1555 bp, Staphylococcus sp. UMB0328
  ref <308>: DATABASE ACCESSION NUMBER: NCBI ACCESSION: NZ_PNFS01000002.1
  ref <309>: DATABASE ENTRY DATE: 2019-04-01
  ref <313>: RELEVANT RESIDUES IN SEQ ID NO: (1)..(1555)
tttatggagagtttgatcctggctcaggatgaacgctggcggcgtgcctaatacatgcaagtcgagcgaacagataaggagcttgctcctttgacgttagcggcggacgggtgagtaacacgtggataacctacctataagactgggataacttcgggaaaccggagctaataccggataacatattgaaccgcatggttcaatagtgaaaggcggctttgctgtcacttatagatggatccgcgccgtattagctagttggtaaggtgacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttatcagggaagaacaaatgtgtaagtaactgtgcacatcttgacggtacctgatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagctaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaaggtagccgtatcggaaggtgcggctggatcacctcctttct

SEQ ID NO: 9031 - DNA, 1130 bp, Staphylococcus sp. URHA0057
  ref <308>: DATABASE ACCESSION NUMBER: NCBI ACCESSION: NZ_JHVS01000030.1
  ref <309>: DATABASE ENTRY DATE: 2019-04-01
  ref <313>: RELEVANT RESIDUES IN SEQ ID NO: (1)..(1130)
cggagctaataccggataagattttgaaccgcatggttcaatagtgaaagacggccttgctgtcacttatagatggatccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttatcagggaagaacaaacgtgtaagtaactgtgcacgtcttgacggtacctgatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagttttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagctaaaccgcgaggtcaagcaaatcc

SEQ ID NO: 9032 - DNA, 1557 bp, Staphylococcus sp. ZWU0021; identical to SEQ ID NO: 8915
  ref <308>: DATABASE ACCESSION NUMBER: NCBI ACCESSION: NZ_JTLN01000014.1
  ref <309>: DATABASE ENTRY DATE: 2019-04-01
  ref <313>: RELEVANT RESIDUES IN SEQ ID NO: (1)..(1557)

SEQ ID NO: 9033 - DNA, 1555 bp, Staphylococcus stepanovicii
  ref <308>: DATABASE ACCESSION NUMBER: NCBI ACCESSION: NZ_LT906462.1
  ref <309>: DATABASE ENTRY DATE: 2019-04-01
  ref <313>: RELEVANT RESIDUES IN SEQ ID NO: (1)..(1555)
ttatggagagtttgatcctggctcaggatgaacgctggcggcgtgcctaatacatgcaagtcgagcgaacagatgagaagcttgcttctctgatgttagcggcggacgggtgagtaacacgtgggtaacctacctataagactgggataactccgggaaaccggggctaataccggataatattttgaaccgcatggttcgatagtgaaagacggtttcggctgtcacttatagatggacccgcgccgtattagctagttggtaaggtaatggcttaccaaggcgacgatacgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaaactctgttgttagggaagaacaaatttgttagtaactgaacaagtcttgacggtacctaaccagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactggggaacttgagtgcagaagaggagagtggaattccatgtgtagcggtgaaatgcgcagagatatggaggaacaccagtggcgaaggcggctctctggtctgtaactgacgctgaggtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgatcgctctagagatagagttttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacacgtgctacaatggataatacaaagggcagcgaacccgcgaggtcaagcaaatcccataaaattattctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaacctttataggagctagccgtcgaaggtgggacagatgattggggtgaagtcgtaacaaggtagccgtatcggaaggtgcggctggatcacctcctttct

SEQ ID NO: 9034 - DNA, 1556 bp, Staphylococcus succinus
  ref <308>: DATABASE ACCESSION NUMBER: NCBI ACCESSION: NZ_QYIV01000113.1
  ref <309>: DATABASE ENTRY DATE: 2019-04-01
  ref <313>: RELEVANT RESIDUES IN SEQ ID NO: (1)..(1556)
tttatggagagtttgatcctggctcaggatgaacgctggcggcgtgcctaatacatgcaagtcgagcgaacggataaggagcttgctcctttgaagttagcggcggacgggtgagtaacacgtgggtaacctacctataagactggaataacttcgggaaaccggagctaatgccggataacatatagaaccgcatggttctatagtgaaagatggttttgctatcacttatagatggacccgcgccgtattagctagttggtaaggtaatggcttaccaaggcgacgatacgtagccgacctgagagggtgatcggccacactggaactgagacacggtccagactcctacgggaggcagcagtagggaatcttccgcaatgggcgaaagcctgacggagcaacgccgcgtgagtgatgaaggttttcggatcgtaaaactctgttattagggaagaacaaatgcgtaagtaactgtgcgcatcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaaaactctagagatagagccttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccattttatggagctagccgtcgaaggtgggacaaatgattggggtgaagtcgtaacaaggtagccgtatcggaaggtgcggctggatcacctcctttct

SEQ ID NO: 9035 - DNA, 1557 bp, Staphylococcus vitulinus
  ref <308>: DATABASE ACCESSION NUMBER: NCBI ACCESSION: NZ_RXWX01000013.1
  ref <309>: DATABASE ENTRY DATE: 2019-04-01
  ref <313>: RELEVANT RESIDUES IN SEQ ID NO: (1)..(1557)
ttatggagagtttgatcctggctcaggatgaacgctggcggcgtgcctaatacatgcaagtcgagcgaacagatgagaagcttgcttctctgatgttagcggcggacgggtgagtaacacgtgggtaacctacctataagactgggataactccgggaaaccggggctaatacctgataatattttgaaccgcatggttcaatagtgaaagacggcttcggctgtcacttatagatggacccgcgccgtattagctagttggtaaggtaatggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttaggatcgtaaaactctgttgttagggaagaacaaatttgttagtaactgaacaagtcttgacggtacctaaccagaaagccacggctaactacgtgccagcagccgcggtaatacgtaggtggcaagcgttatccggaattattgggcgtaaagcgcgcgtaggcggtttcttaagtctgatgtgaaagtccacggctcaaccgtggaaggtcattggaaactggggaacttgagtgcagaagaggagagtggaattccatgtgtagcggtgaaatgcgcagagatatggaggaacaccagtggcgaaggcggctctctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgatcgctctagagatagagttttccccttcgggggacaaagtgacaggtggtgcatggttgtcgtcagctcgtgtcgtgagatgttgggttaagtcccgcaacgagcgcaacccttaagcttagttgccatcattaagttgggcactctaggttgactgccggtgacaaaccggaggaaggtggggatgacgtcaaatcatcatgccccttatgatttgggctacacacgtgctacaatggataatacaaagggcagcgaaaccgcgaggtcaagcaaatcccataaaattattctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccttttattaggagctagccgtcgaaggtgggacagatgattggggtgaagtcgtaacaaggtagccgtatcggaaggtgcggctggatcacctcctttct

SEQ ID NO: 9036 - DNA, 1555 bp, Staphylococcus warneri; identical to SEQ ID NO: 8814
  ref <308>: DATABASE ACCESSION NUMBER: NCBI ACCESSION: NZ_LR134269.1
  ref <309>: DATABASE ENTRY DATE: 2019-04-01
  ref <313>: RELEVANT RESIDUES IN SEQ ID NO: (1)..(1555)

SEQ ID NO: 9037 - DNA, 1555 bp, Staphylococcus xylosus
  ref <308>: DATABASE ACCESSION NUMBER: NCBI ACCESSION: NZ_UHEJ01000002.1
  ref <309>: DATABASE ENTRY DATE: 2019-04-01
  ref <313>: RELEVANT RESIDUES IN SEQ ID NO: (1)..(1555)
tttatggagagtttgatcctggctcaggatgaacgctggcggcgtgcctaatacatgcaagtcgagcgaacagataaggagcttgctcctttgacgttagcggcggacgggtgagtaacacgtgggtaacctacctataagactggaataactccgggaaaccggggctaatgccggataatatttagaaccgcatggttctaaagtgaaagatggttttactatcacttatagatggacccgcgccgtattagctagttggtggggtaatggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttattagggaagaacaaatgtgtaagtaactgtgcacgtcttgacggtacctaatcagaaagccacggctaactacgtgccagcagccgcggtaatacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgacaactctagagatagagtcttccccttcgggggacaaagtgacaggtggtgcatggttgtcgtcagctcgtgtcgtgagatgttgggttaagtcccgcaacgagcgcaacccttaagcttagttgccagcattaagttgggcactctaagttgactgccggtgacaaaccggaggaaggtggggatgacgtcaaatcatcatgccccttatgatttgggctacacacgtgctacaatggacaatacaaagggcagctaaaccgcgaggtcatgcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtctgtaacacccgaagccggtggagtaaccatttatggagctagccgtcgaaggtgggacaaatgattggggtgaagtcgtaacaaggtagccgtatcggaaggtgcggctggatcacctcctttct

SEQ ID NO: 9038 - DNA, 1488 bp, Stappia indica
  ref <308>: DATABASE ACCESSION NUMBER: NCBI ACCESSION: NZ_OBML01000007.1
  ref <309>: DATABASE ENTRY DATE: 2019-04-01
  ref <313>: RELEVANT RESIDUES IN SEQ ID NO: (1)..(1488)
caacctgagagtttgatcctggctcagaacgaacgctggcggcaggcttaacacatgcaagtcgaacggtctcttcggaggcagtggcagacgggtgagtaacgcgtgggaacatacctttcggtacggaacaacagttggaaacgactgctaataccgtatacgccctgagggggaaagatttatcgccgagagattggcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgccggtgaagataatgacggtaaccggtaaagaagccccggctaacttcgtgccagcagccgcggtaatacgaagggggctagcgttgttcggaattactgggcgtaaagcgcacgtaggctgacttttaagtcaggggtgaaatcccggggctcaacctcggaactgcctttgatactggaagtcttgagtccgagagaggtgagtggaactccgagtgtagaggtgaaattcgtagatattcggaagaacaccagtggcgaaggcggctcactggctcggtactgacgctgaggtgcgaaagcgtggggagcaaacaggattagataccctggtagtccacgccgtaaacgatggaagctagctgtcaggtagcatgctatttggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatgtccggcacactccagagatggggttttcccttcggggaccggagcacaggtgctgcatggctgtcgtcagctcgtgtcgtgagatgttgggttaagtcccgcaacgagcgcaaccctcgcccttagttgccagcattaagttgggcactctagggggactgccggtgataagccgagaggaaggtggggatgacgtcaagtcctcatggcccttacgggctgggctacacacgtgctacaatggcggtgacaatgggcagcgaaggggcgacccggagctaatcttgaaaaaccgtctcagttcggattgttctctgcaactcgagagcatgaagttggaatcgctagtaatcgcgtaacagcatgacgcggtgaatacgttcccgggccttgtacacaccgcccgtcacaccatgggagttggctttacccgaaggtggtgcgctaacccgcaagggaggcagccaaccacggtagggtcagcgactggggtgaagtcgtaacaaggtagccgtaggggaacctgcggctggatcacctcctttcta

SEQ ID NO: 9039 - DNA, 834 bp, Stappia sp. 22II-S9-Z10
  ref <308>: DATABASE ACCESSION NUMBER: NCBI ACCESSION: NZ_AQRB01000027.1
  ref <309>: DATABASE ENTRY DATE: 2019-04-01
  ref <313>: RELEVANT RESIDUES IN SEQ ID NO: (1)..(834)
gggcgaaagcctgatccagccatgccgcgtgagtgatgacggccttagggttgtaaagctctttcgctagggatgataatgacagtacctagtaaagaagccccggctaacttcgtgccagcagccgcggtaatacgaagggggctagcgttgttcggaattactgggcgtaaagcgcgcgtaggcggatcattaagtcaggggtgaaatcccggggctcaacctcggaattgcctctgatactggtggtcttgagtccgtgagaggtgagtggaactccgagtgtagaggtgaaattcgtagatattcggaagaacaccagtggcgaaggcggctcactggcacggtactgacgctgaggtgcgaaagcgtggggagcaaacaggattagataccctggtagtccacgccgtaaacgatgatagctagccgtcggggtgcatgcacctcggtggcgcagttaacgcattaagctatccgcctggggagtacggtcgcaagattaaaactcaaaggaattgacgggggcctgcacaagcggtggagcatgtggtttaattcgaagcaacgcgcagaaccttaccagctcttgacatcccctgctcgctggagagatccagttttcccttcggggacagggtgacaggtgctgcatggctgtcgtcagctcgtgtcgtgagatgttgggttaagtcccgcaacgagcgcaaccctcgcctctagttgccagcatttggttgggcactctagagggactgccggtgataagccgagaggaaggtggggatgacgtcaagtcctcatggcccttacgggctgggctacacacgtgct

SEQ ID NO: 9040 - DNA, 1489 bp, Stappia sp. ARW1T
  ref <308>: DATABASE ACCESSION NUMBER: NCBI ACCESSION: NZ_RAPU01000007.1
  ref <309>: DATABASE ENTRY DATE: 2019-04-01
  ref <313>: RELEVANT RESIDUES IN SEQ ID NO: (1)..(1489)
caacctgagagtttgatcctggctcagaacgaacgctggcggcaggcttaacacatgcaagtcgaacggtctcttcggaggcagtggcagacgggtgagtaacgcgtgggaacatacctttcggtacggaacaacagttggaaacgactgctaataccgtatacgccctgagggggaaagatttatcgccgagagattggcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgccggtgaagataatgacggtaaccggtaaagaagccccggctaacttcgtgccagcagccgcggtaatacgaagggggctagcgttgttcggaattactgggcgtaaagcgcacgtaggctgacttttaagtcaggggtgaaatcccggggctcaacctcggaactgcctttgatactggaagtcttgagtccgagagaggtgagtggaactccgagtgtagaggtgaaattcgtagatattcggaagaacaccagtggcgaaggcggctcactggctcggtactgacgctgaggtgcgaaagcgtggggagcaaacaggattagataccctggtagtccacgccgtaaacgatggaagctagctgtcaggtagcatgctatttggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatgtccggcacactccagagatggggttttcccttcggggaccggagcacaggtgctgcatggctgtcgtcagctcgtgtcgtgagatgttgggttaagtcccgcaacgagcgcaaccctcgcccttagttgccagcattaagttgggcactctagggggactgccggtgataagccgagaggaaggtggggatgacgtcaagtcctcatggcccttacgggctgggctacacacgtgctacaatggcggtgacaatgggcagcgaaggggcgacccggagctaatcttgaaaaaccgtctcagttcggattgttctctgcaactcgagagcatgaagttggaatcgctagtaatcgcgtaacagcatgacgcggtgaatacgttcccgggccttgtacacaccgcccgtcacaccatgggagttggctttacccgaaggtggtgcgctaacccgcaagggaggcagccaaccacggtagggtcagcgactggggtgaagtcgtaacaaggtagccgtaggggaacctgcggctggatcacctcctttctaa

SEQ ID NO: 9041 - DNA, 1503 bp, Stappia stellulata
  ref <308>: DATABASE ACCESSION NUMBER: NCBI ACCESSION: NZ_KE384082.1
  ref <309>: DATABASE ENTRY DATE: 2019-04-01
  ref <313>: RELEVANT RESIDUES IN SEQ ID NO: (1)..(1503)
cttttggttcaacctgagagtttgatcctggctcagaacgaacgctggcggcaggcttaacacatgcaagtcgaacggtctcttcggaggcagtggcagacgggtgagtaacgcgtgggaacctacctttcggtacggaacaacagttggaaacgactgctaataccgtatacgccccaagggggaaagatttatcgccgaaggatgggcccgcgttggattagctagttggtggggtaatggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgccggtgaagataatgactgtagccggtaaagaagccccggctaacttcgtgccagcagccgcggtaatacgaagggggctagcgttgttcggaattactgggcgtaaagcgcacgtaggctgacttttaagtcaggggtgaaatcccgaggctcaacctcggaactgcctttgatactggaagtcttgagtccgagagaggtgagtggaactccgagtgtagaggtgaaattcgtagatattcggaagaacaccagtggcgaaggcggctcactggctcggtactgacgctgaggtgcgaaagcgtggggagcaaacaggattagataccctggtagtccacgccgtaaactatggaagctagctgtcaggtagcatgctatttggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatgtccggcacacgatagagatgtcgttttcccttcggggaccggagcacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggcggtgacaatgggcagcgaaggggcgacccggagctaatctttaaaaaccgtctcagttcggattgttctctgcaactcgagagcatgaagttggaatcgctagtaatcgcgtaacagcatgacgcggtgaatacgttcccgggccttgtacacaccgcccgtcacaccatgggagttggctttacccgaaggtggtgcgctaacctggcaacaggaggcagccaaccacggtagggtcagcgactggggtgaagtcgtaacaaggtagccgtaggggaacctgcggctggatcacctcctttctaagga

SEQ ID NO: 9042 - DNA, 1497 bp, Starkeya novella
  ref <308>: DATABASE ACCESSION NUMBER: NCBI ACCESSION: NC_014217.1
  ref <309>: DATABASE ENTRY DATE: 2019-04-01
  ref <313>: RELEVANT RESIDUES IN SEQ ID NO: (1)..(1497)
tcattcaacttgagagtttgatcctggctcagaacgaacgctggcggcaggcttaacacatgcaagtcgaacgcaccgcaaggtgagtggcagacgggtgagtaacacgtggggatctgcccaatggtacggaatagctccgggaaactggaattaataccgtatgtgcccgcaaggggaaagatttatcgccattggatgaacccgcgtcggattagctagttggtgtggtaaaggcgcaccaaggcgacgatccgtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgccgacgaagataatgacggtagtcggagaagaagccccggctaacttcgtgccagcagccgcggtaatacgaagggggctagcgttgttcggaatcactgggcgtaaagcgcacgtaggcggattgttaagtcaggggtgaaagcctggagctcaactccagaactgcccttgatactggcaatctcgagtccggaagaggtaagtggaactgcgagtgtagaggtgaaattcgtagatattcgcaagaacaccagtggcgaaggcggcttactggtccggtactgacgctgaggtgcgaaagcgtggggagcaaacaggattagataccctggtagtccacgccgtaaacgatggaggctagccgttggtgagcatgctcatcagtggcgcagctaacgcattaagcctcccgcctggggagtacggtcgcaagattaaaactcaaaggaattgacgggggcccgcacaagcggtggagcatgtggtttaattcgaagcaacgcgcagaaccttaccagcctttgacatgtctcggaattggaccagagatggaccaagctcttcggagccgggaacacaggtgctgcatggctgtcgtcagctcgtgtcgtgagatgttgggttaagtcccgcaacgagcgcaaccctcgcccttagttgccatcattaagttgggcactctagggggactgccggtgataagccgagaggaaggtggggatgacgtcaagtcctcatggcccttacgggctgggctacacacgtgctacaatggcggtgacagtgggatgcgaacccgcgagggtgagcaaatctccaaaagccgtctcagttcggattgcactctgcaactcgagtgcatgaagttggaatcgctagtaatcgtggatcagcacgccacggtgaatacgttcccgggccttgtacacaccgcccgtcacaccatgggagttggctttacccgaaggcgctgcgctaacccgcaagggaggcaggcgaccacggtagggtcagcgactggggtgaagtcgtaacaaggtagccgtaggggaacctgcggctggatcacctcctttctaagga

SEQ ID NO: 9043 - DNA, 1497 bp, Stella humosa
  ref <308>: DATABASE ACCESSION NUMBER: NCBI ACCESSION: NZ_RJKX01000006.1
  ref <309>: DATABASE ENTRY DATE: 2019-04-01
  ref <313>: RELEVANT RESIDUES IN SEQ ID NO: (1)..(1497)
tgaacttgagagtttgatcctggctcagaacgaacgctggcggcatgcctaacacatgcaagtcgaacgaatggcttcggccattagtggcgcacgggtgagtaacgcgtgggaatctgcccagcagtgggggataacctcgggaaactgaggctaataccgcatacgcccctcgggggaaaggcttgctgctgctggaggagcccgcgtcggattaggtagttggtggggtaacggcctaccaagcctgtgatccgtagctggtctgagaggatgatcagccacactgggactgagacacggcccagactcctacgggaggcagcagtggggaatattggacaatgggcgcaagcctgatccagcaatgccgcgtgagtgatgaaggccttcgggttgtaaagctctttcgcccacgacgatgatgacggtagtgggagaagaagccccggctaacttcgtgccagcagccgcggtaatacgaagggggctagcgttgttcggaatgactgggcgtaaagggcgcgtaggcggcgcatcaagtcgggcgtgaaagccccgggctcaacctgggaactgcgttcgagactggtgtgctagagttcgggagaggagagtggaattcccagtgtagaggtgaaattcgtagatattgggaagaacaccaatggcgaaggcagctctctggaccgatactgacgctgaggcgcgaaagcgtggggagcaaacaggattagataccctggtagtccacgccgtaaacgatgaatgctagacgttgggacccctagggtttcagtgtcgccgctaacgcatgaagcattccgcctggggagtacggccgcaaggttaaaactcaaaggaattgacgggggcccgcacaagcggtggagcatgtggtttaattcgacgcaacgcgcagaaccttaccagctcttgacatgggaagtttgggtctgagagatcgggtccttcagttcggctggcttccacacaggtgctgcatggctgtcgtcagctcgtgtcgtgagatgttgggttaagtcccgcaacgagcgcaaccctcatcctcagttgccatcaggtagggctgggcactctggggaaactgccggtgacaagccggaggaaggcggggatgacgtcaagtcctcatggcccttacgggctgggctacacacgtgctacaatggcggtgacagtaggacgcaatggggcgacccggagccaatccactaaaagccgtctcagttcggattgtactctgcaactcgagtgcatgaagctggaatcgctagtaatcgcggatcagcatgccgcggtgaatacgttcccgggccttgtacacaccgcccgtcacaccatgggagttggttttacctgaagccggtgggctaaccgcaaggaggcagccgaccacggtagggtcagcgactggggtgaagtcgtaacaaggtagccgtaggggaacctgcggctggatcacctcctttctgg

SEQ ID NO: 9044 - DNA, 414 bp, Stenotrophomonas bentonitica
  ref <308>: DATABASE ACCESSION NUMBER: NCBI ACCESSION: NZ_PKQP01000032.1
  ref <309>: DATABASE ENTRY DATE: 2019-04-01
  ref <313>: RELEVANT RESIDUES IN SEQ ID NO: (1)..(414)
gtgccagccgccgcggtaatacagagactgcaagcgttattcggattcactgggcgtaaagggtgcgcaggcggtcgtgtgtgtcagatgtgaaatcccggagcttaactccggaactgcgtctgaaactacacgactagagcattggagagggaagtggaattcatggtgtagcagtgaaatgcgtagatatcatgaggaacaccagaggcgaaggcgacttcctggacaattgctgacgctcaggcacgaaagcatggggagcaaaagggattagatacccctgtagtccatgccctaaacggtgcacactaggtcttggaggattcgaccccttcagggcccaagctaacgcgttaagtgtgccgcctgaggactacggtcgcaagactaaaactcaaatgaattgacggg

SEQ ID NO: 9045 - DNA, 1547 bp, Stenotrophomonas rhizophila
  ref <308>: DATABASE ACCESSION NUMBER: NCBI ACCESSION: NZ_FMIT01000023.1
  ref <309>: DATABASE ENTRY DATE: 2019-04-01
  ref <313>: RELEVANT RESIDUES IN SEQ ID NO: (1)..(1547)
taagtgaagagtttgatcctggctcagagtgaacgctggcggtaggcctaacacatgcaagtcgaacggcagcacagtaagagcttgctcttatgggtggcgagtggcggacgggtgaggaatacatcggaatctaccttttcgtgggggataacgtagggaaacttacgctaataccgcatacgaccttcgggtgaaagcaggggaccttcgggccttgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaaagcagtcggctaatacccggttgttctgacggtacccaaagaataagcaccggctaacttcgtgccagcagccgcggtaatacgaagggtgcaagcgttactcggaattactgggcgtaaagcgtgcgtaggtggttgtttaagtctgttgtgaaagccctgggctcaacctgggaattgcagtggatactgggcgactagagtgtggtagagggtagtggaattcccggtgtagcagtgaaatgcgtagagatcgggaggaacatccatggcgaaggcagctacctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaaacccgcgagggcaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgtatcggaaggtgcggctggatcacctccttt

SEQ ID NO: 9046 - DNA, 1545 bp, Stenotrophomonas sp. 278
  ref <308>: DATABASE ACCESSION NUMBER: NCBI ACCESSION: NZ_RHPP01000202.1
  ref <309>: DATABASE ENTRY DATE: 2019-04-01
  ref <313>: RELEVANT RESIDUES IN SEQ ID NO: (1)..(1545)
taagtgaagagtttgatcctggctcagagtgaacgctggcggtaggcctaacacatgcaagtcgaacggcagcacaggagagcttgctctctgggtggcgagtggcggacgggtgaggaatacatcggaatctaccttttcgtgggggataacgtagggaaacttacgctaataccgcatacgaccttcgggtgaaagcaggggaccttcgggccttgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaaagcagccagctaatacctggttgttctgacggtacccaaagaataagcaccggctaacttcgtgccagcagccgcggtaatacgaagggtgcaagcgttactcggaattactgggcgtaaagcgtgcgtaggtggttgtttaagtctgttgtgaaagccctgggctcaacctgggaattgcagtggatactgggcgactagagtgtggtagagggtagtggaattcctggtgtagcagtgaaatgcgtagagatcaggaggaacatccatggcgaaggcagctacctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaaacccgcgagggcaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgtatcggaaggtgcggctggatcacctccttt

SEQ ID NO: 9047 - DNA, 1547 bp, Stenotrophomonas sp. Betaine-02u-21
  ref <308>: DATABASE ACCESSION NUMBER: NCBI ACCESSION: NZ_PJAW01000027.1
  ref <309>: DATABASE ENTRY DATE: 2019-04-01
  ref <313>: RELEVANT RESIDUES IN SEQ ID NO: (1)..(1547)
taagtgaagagtttgatcctggctcagagtgaacgctggcggtaggcctaacacatgcaagtcgaacggcagcacagtaagagcttgctcttatgggtggcgagtggcggacgggtgaggaatacatcggaatctactttttcgtgggggataacgtagggaaacttacgctaataccgcatacgaccttcgggtgaaagcaggggaccttcgggccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaaagcagcgggctaataccttgctgttctgacggtacccaaagaataagcaccggctaacttcgtgccagcagccgcggtaatacgaagggtgcaagcgttactcggaattactgggcgtaaagcgtgcgtaggtggttgtttaagtctgttgtgaaagccctgggctcaacctgggaactgcagtggaaactggatgactagagtgtggtagagggtagcggaattcccggtgtagcagtgaaatgcgtagagatcgggaggaacatccatggcgaaggcagctacctggaccaacactgacactgaggcacgaaagcgtggggagcaaacaggattagataccctggtagtccacgccctaaacgatgcgaactggatgttgggtgcactttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgtatcggaaggtgcggctggatcacctccttt

SEQ ID NO: 9048 - DNA, 1547 bp, Stenotrophomonas sp. Betaine-02u-23; identical to SEQ ID NO: 9047
  ref <308>: DATABASE ACCESSION NUMBER: NCBI ACCESSION: NZ_PJAX01000039.1
  ref <309>: DATABASE ENTRY DATE: 2019-04-01
  ref <313>: RELEVANT RESIDUES IN SEQ ID NO: (1)..(1547)

SEQ ID NO: 9049 - DNA, 1547 bp, Stenotrophomonas sp. Bg11-02; identical to SEQ ID NO: 9047
  ref <308>: DATABASE ACCESSION NUMBER: NCBI ACCESSION: NZ_PJAY01000016.1
  ref <309>: DATABASE ENTRY DATE: 2019-04-01
  ref <313>: RELEVANT RESIDUES IN SEQ ID NO: (1)..(1547)

SEQ ID NO: 9050 - DNA, 1545 bp, Stenotrophomonas sp. ESTM1D MKCIP4 1
  ref <308>: DATABASE ACCESSION NUMBER: NCBI ACCESSION: NZ_CP026004.1
  ref <309>: DATABASE ENTRY DATE: 2019-04-01
  ref <313>: RELEVANT RESIDUES IN SEQ ID NO: (1)..(1545)
taagtgaagagtttgatcctggctcagagtgaacgctggcggtaggcctaacacatgcaagtcgaacggcagcacaggagagcttgctctctgggtggcgagtggcggacgggtgaggaatacatcggaatctactttttcgtgggggataacgtagggaaacttacgctaataccgcatacgacctacgggtgaaagcaggggaccttcgggccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagctggctaatacccggttgggatgacggtacccaaagaataagcaccggctaacttcgtgccagcagccgcggtaatacgaagggtgcaagcgttactcggaattactgggcgtaaagcgtgcgtaggtggttgtttaagtctgttgtgaaagccctgggctcaacctgggaactgcagtggaaactggacgactagaatgtggtagagggtagcggaattcctggtgtagcagtgaaatgcgtagagatcaggaggaacatccatggcgaaggcagctacctggaccaacattgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgtatcggaaggtgcggctggatcacctccttt

SEQ ID NO: 9051 - DNA, 1547 bp, Stenotrophomonas sp. HMWF003
  ref <308>: DATABASE ACCESSION NUMBER: NCBI ACCESSION: NZ_QAIW01000093.1
  ref <309>: DATABASE ENTRY DATE: 2019-04-01
  ref <313>: RELEVANT RESIDUES IN SEQ ID NO: (1)..(1547)
taagtgaagagtttgatcctggctcagagtgaacgctggcggtaggcctaacacatgcaagtcgaacggcagcacagtaagagcttgctcttatgggtggcgagtggcggacgggtgaggaatacatcggaatctaccttttcgtgggggataacgtagggaaacttacgctaataccgcatacgaccttcgggtgaaagcaggggaccttcgggccttgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaaagcagctggctaatacccggttgttctgacggtacccaaagaataagcaccggctaacttcgtgccagcagccgcggtaatacgaagggtgcaagcgttactcggaattactgggcgtaaagcgtgcgtaggtggttgtttaagtctgttgtgaaagccctgggctcaacctgggaattgcagtggatactgggcgactagagtgtggtagagggtagtggaattcccggtgtagcagtgaaatgcgtagagatcgggaggaacatccatggcgaaggcagctacctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaaacccgcgagggcaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgtatcggaaggtgcggctggatcacctccttt

SEQ ID NO: 9052 - DNA, 1545 bp, Stenotrophomonas sp. SAU14A NAIMI4 8
  ref <308>: DATABASE ACCESSION NUMBER: NCBI ACCESSION: NZ_CP025999.1
  ref <309>: DATABASE ENTRY DATE: 2019-04-01
  ref <313>: RELEVANT RESIDUES IN SEQ ID NO: (1)..(1545)
taagtgaagagtttgatcctggctcagagtgaacgctggcggtaggcctaacacatgcaagtcgaacggcagcacaggagagcttgctctctgggtggcgagtggcggacgggtgaggaatacatcggaatctactttttcgtgggggataacgtagggaaacttacgctaataccgcatacgacctacgggtgaaagcaggggaccttcgggccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagccggctaatacctggttgggatgacggtacccaaagaataagcaccggctaacttcgtgccagcagccgcggtaatacgaagggtgcaagcgttactcggaattactgggcgtaaagcgtgcgtaggtggtcgtttaagtctgttgtgaaagccctgggctcaacctgggaactgcagtggaaactggacgactagagtgtggtagagggtagcggaattcctggtgtagcagtgaaatgcgtagagatcaggaggaacatccatggcgaaggcagctacctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgtatcggaaggtgcggctggatcacctccttt

SEQ ID NO: 9053 - DNA, 1545 bp, Stenotrophomonas sp. VV52
  ref <308>: DATABASE ACCESSION NUMBER: NCBI ACCESSION: NZ_PKQQ01000032.1
  ref <309>: DATABASE ENTRY DATE: 2019-04-01
  ref <313>: RELEVANT RESIDUES IN SEQ ID NO: (1)..(1545)
taagtgaagagtttgatcctggctcagagtgaacgctggcggtaggcctaacacatgcaagtcgaacggcagcacaggagagcttgctctctgggtggcgagtggcggacgggtgaggaatacatcggaatctaccttttcgtgggggataacgtagggaaacttacgctaataccgcatacgaccttcgggtgaaagcaggggaccttcgggccttgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaaagcagccggttaatacccggttgttctgacggtacccaaagaataagcaccggctaacttcgtgccagcagccgcggtaatacgaagggtgcaagcgttactcggaattactgggcgtaaagcgtgcgtaggtggttgtttaagtctgttgtgaaagccctgggctcaacctgggaattgcagtggatactgggcgactagagtgtggtagagggtagtggaattcctggtgtagcagtgaaatgcgtagagatcaggaggaacatccatggcgaaggcagctacctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaaacccgcgagggcaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgtatcggaaggtgcggctggatcacctccttt

SEQ ID NO: 9054 - DNA, 1545 bp, Stenotrophomonas sp. YAU14A MKIMI4 1; identical to SEQ ID NO: 9052
  ref <308>: DATABASE ACCESSION NUMBER: NCBI ACCESSION: NZ_CP025998.1
  ref <309>: DATABASE ENTRY DATE: 2019-04-01
  ref <313>: RELEVANT RESIDUES IN SEQ ID NO: (1)..(1545)

SEQ ID NO: 9055 - DNA, 1545 bp, Stenotrophomonas sp. YAU14D1 LEIMI4 1
  ref <308>: DATABASE ACCESSION NUMBER: NCBI ACCESSION: NZ_CP025997.1
  ref <309>: DATABASE ENTRY DATE: 2019-04-01
  ref <313>: RELEVANT RESIDUES IN SEQ ID NO: (1)..(1545)
taagtgaagagtttgatcctggctcagagtgaacgctggcggtaggcctaacacatgcaagtcgaacggcagcacaggagagcttgctctctgggtggcgagtggcggacgggtgaggaatacatcggaatctactttttcgtgggggataacgtagggaaacttacgctaataccgcatacgacctacgggtgaaagcaggggaccttcgggccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagccggttaatacctggttgggatgacggtacccaaagaataagcaccggctaacttcgtgccagcagccgcggtaatacgaagggtgcaagcgttactcggaattactgggcgtaaagcgtgcgtaggtggtcgtttaagtctgttgtgaaagccctgggctcaacctgggaactgcagtggaaactggacgactagagtgtggtagagggtagcggaattcctggtgtagcagtgaaatgcgtagagatcaggaggaacatccatggcgaaggcagctacctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgtatcggaaggtgcggctggatcacctccttt

SEQ ID NO: 9056 - DNA, 1547 bp, Stenotrophomonas sp. ZAC14A NAIMI4 1
  ref <308>: DATABASE ACCESSION NUMBER: NCBI ACCESSION: NZ_CP026002.1
  ref <309>: DATABASE ENTRY DATE: 2019-04-01
  ref <313>: RELEVANT RESIDUES IN SEQ ID NO: (1)..(1547)
taagtgaagagtttgatcctggctcagagtgaacgctggcggtaggcctaacacatgcaagtcgaacggcagcacagtaagagcttgctcttatgggtggcgagtggcggacgggtgaggaatacatcggaatctactttttcgtgggggataacgtagggaaacttacgctaataccgcatacgacctacgggtgaaagcaggggaccttcgggccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagccggctaatacctggttgggatgacggtacccaaagaataagcaccggctaacttcgtgccagcagccgcggtaatacgaagggtgcaagcgttactcggaattactgggcgtaaagcgtgcgtaggtggttgtttaagtctgttgtgaaagccctgggctcaacctgggaactgcagtggaaactggacgactagagtgtggtagagggtagcggaattcctggtgtagcagtgaaatgcgtagagatcaggaggaacatccatggcgaaggcagctacctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgtatcggaaggtgcggctggatcacctccttt

SEQ ID NO: 9057 - DNA, 1545 bp, Stenotrophomonas sp. ZAC14D2 NAIMI4 6; identical to SEQ ID NO: 9055
  ref <308>: DATABASE ACCESSION NUMBER: NCBI ACCESSION: NZ_CP025996.1
  ref <309>: DATABASE ENTRY DATE: 2019-04-01
  ref <313>: RELEVANT RESIDUES IN SEQ ID NO: (1)..(1545)

SEQ ID NO: 9058 - DNA, 1547 bp, Stenotrophomonas sp. ZAC14D2 NAIMI4 7
  ref <308>: DATABASE ACCESSION NUMBER: NCBI ACCESSION: NZ_CP025995.1
  ref <309>: DATABASE ENTRY DATE: 2019-04-01
  ref <313>: RELEVANT RESIDUES IN SEQ ID NO: (1)..(1547)
taagtgaagagtttgatcctggctcagagtgaacgctggcggtaggcctaacacatgcaagtcgaacggcagcacagtaagagcttgctcttacgggtggcgagtggcggacgggtgaggaatacatcggaatctactttttcgtgggggataacgtagggaaacttacgctaataccgcatacgacctacgggtgaaagcaggggaccttcgggccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagccggttaatacctggttgggatgacggtacccaaagaataagcaccggctaacttcgtgccagcagccgcggtaatacgaagggtgcaagcgttactcggaattactgggcgtaaagcgtgcgtaggtggtcgtttaagtctgttgtgaaagccctgggctcaacctgggaactgcagtggaaactggacgactagagtgtggtagagggtagcggaattcctggtgtagcagtgaaatgcgtagagatcaggaggaacatccatggcgaaggcagctacctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgcttgccacggtgtggccgatgactggggtgaagtcgtaacaaggtagccgtatcggaaggtgcggctggatcacctccttt

SEQ ID NO: 9059 - DNA, 1547 bp, Stenotrophomonas tumulicola; identical to SEQ ID NO: 9047

SEQ ID NO: 9060 - DNA, 1541 bp, Steroidobacter agariperforans
  ref <308>: DATABASE ACCESSION NUMBER: NCBI ACCESSION: NZ_RYFW01000002.1
  ref <309>: DATABASE ENTRY DATE: 2019-04-01
  ref <313>: RELEVANT RESIDUES IN SEQ ID NO: (1)..(1541)
taagtgaagagtttgatcctggctcagattgaacgctggcggcgtgcctaacacatgcaagtcgagcggtaacaggtgtagcaatacatgctgacgagcggcggacgggtgagtaacgcttgggaatctgcctgttagtgggggacaaccaaccgaaaggttggctaataccgcatacgcactacggtggaaagccggggaccgcaaggcctggcgctaacagatgagcccaagtcggattagctagttggtagggtaacggcctaccaaggcgacgatccgtaactggtctgagaggacgaccagtcacaccggaactgagacacggtccggactcctacgggaggcagcagtggggaatattggacaatgggggcaaccctgatccagcgacgccgcgtgggtgaagaaggcctgcgggttgtaaagccctttcggttgggaagaaaagctgcgacctaacacgtcgcggccttgacgtaaccaactaaagaagcaccggctaactctgtgccagcagccgcggtaatacagagggtgcgagcgttaatcggaattactgggcgtaaagcgcgcgtaggcggctttgtaagtcggttgtgaaatccccgggcttaacctgggaactgcatccgagactgcatagctagagtatgggagagggaagtggaatttcaggtgtagcggtgaaatgcgtagatatctgaaggaacatcagtggcgaaagcgacttcctggaccaatactgacgctcatgtgcgaaagcgtggggagcaaacaggattagataccctggtagtccacgccataaacgatgagaactggatgtcggaggggtctgcccttcggtgtcgtagctaacgcgttaagttctccgcctggggagtacggccgcaaggttgaaactcaaaggaattgacggggacccgcacaagcggtggagcatgtggtttaattcgatgcaacgcgaagaaccttacctggtcttgacatcctaggaaccctgcagagatgtgggggtgccttcgggaacctggagacaggtgctgcatggctgtcgtcagctcgtgtcgtgagatgttgggttaagtcccgcaacgagcgcaacccttgcccttagttgccagcattaagttgggaactctaaggggaccgccggtgacaaaccggaggaaggtggggatgacgtcaagtcatcatggcccttatgaccagggctacacacgtgctacaatggccagtacaaagggttgccaacccgcgagggggagccaatcccaaaaagctggtcgtagtccggatcgcagtctgcaactcggctgcgtgaagtcggaatcgctagtaatcgtgaatcagcgatgtcacggtgaatacgttcccgggtcttgtacacaccgcccgtcacaccatgggagttgattgcaccagaagtaggtagcctaaccgcaaggagggcgcttaccacggtgtggtcaatgactggggtgaagtcgtaacaaggtagccgtacgggaacgtgcggctggatcacctcctttaaa

SEQ ID NO: 9061 - DNA, 1539 bp, Steroidobacter cummioxidans
  ref <308>: DATABASE ACCESSION NUMBER: NCBI ACCESSION: NZ_LSRW01000126.1
  ref <309>: DATABASE ENTRY DATE: 2019-04-01
  ref <313>: RELEVANT RESIDUES IN SEQ ID NO: (1)..(1539)
taagtgaagagtttgatcctggctcagattgaacgctggcggcgtgcctaacacatgcaagtcgagcggtagcaggtgtagcaatacatgctgacgagcggcggacgggtgagtaacgcttgggaatctgcctgttagtgggggacaacccggggaaactcgggctaataccgcatacgcactacggtggaaagccggggaccgcaaggcctggcgctaacagatgagcccaagtcggattagctagttggtagggtaatggcctaccaaggcgacgatccgtaactggtctgagaggacgaccagtcacaccggaactgagacacggtccggactcctacgggaggcagcagtggggaatattggacaatgggggaaaccctgatccagcgacgccgcgtgggtgaagaaggcctgcgggttgtaaagccctttcggttgggaagaaaagttgcgacctaacacgtcgcgaccttgacgtaaccaactaaagaagcaccggctaactctgtgccagcagccgcggtaatacagagggtgcgagcgttaatcggaattactgggcgtaaagcgcgcgtaggcggctttgcaagccggatgtgaaatccccgggcttaacctgggaactgcattcgggactgcattgctagagtatgggagagggaagtggaatttcaggtgtagcggtgaaatgcgtagatatctgaaggaacatcagtggcgaaagcgacttcctggaccaatactgacgctcatgtgcgaaagcgtggggagcaaacaggattagataccctggtagtccacgccataaacgatgagaactggatgtcgggagggtctgcctctcggtgtcgtagctaacgcgttaagttctccgcctggggagtacggccgcaaggttgaaactcaaaggaattgacggggacccgcacaagcggtggagcatgtggtttaattcgatgcaacgcgaagaaccttacctggtcttgacatcctaggaatcctgcagagatgtgggagtgccttcgggaacctggagacaggtgctgcatggctgtcgtcagctcgtgtcgtgagatgttgggttaagtcccgcaacgagcgcaacccttgcccttagttgccagcattcagttgggaactctaaggggaccgccggtgacaaaccggaggaaggtggggatgacgtcaagtcatcatggcccttatgaccagggctacacacgtgctacaatggccagtacaaagggttgccaacccgcgagggggagccaatcccataaagctggtcgtagtccggatcgcagtctgcaactcggctgcgtgaagtcggaatcgctagtaatcgtgaatcagcgatgtcacggtgaatacgttcccgggtcttgtacacaccgcccgtcacaccatgggagttgattgcaccagaagtaggtagcctaaccgcaaggagggcgcttaccacggtgtggtcaatgactggggtgaagtcgtaacaaggtagccgtacgggaacgtgcggctggatcacctccttta

SEQ ID NO: 9062 - DNA, 1541 bp, Steroidobacter sp. JW-3
  ref <308>: DATABASE ACCESSION NUMBER: NCBI ACCESSION: NZ_ML142848.1
  ref <309>: DATABASE ENTRY DATE: 2019-04-01
  ref <313>: RELEVANT RESIDUES IN SEQ ID NO: (1)..(1541)
taagtgaagagtttgatcctggctcagattgaacgctggcggcgtgcctaacacatgcaagtcgagcggtagcaggtgtagcaatacatgctgacgagcggcggacgggtgagtaacgcttgggaatctgcctgttagtgggggacaacacggggaaactcgtgctaataccgcatacgcactacggtggaaagccggggaccgcaaggcctggcgctaacagatgagcccaagtcggattagctagttggtagggtaacggcctaccaaggcgacgatccgtaactggtctgagaggacgaccagtcacaccggaactgagacacggtccggactcctacgggaggcagcagtggggaatattggacaatgggggaaaccctgatccagcgacgccgcgtgggtgaagaaggcctgcgggttgtaaagccctttcggttgggaagaaaagttgcggtttaacacatcgcgaccttgacgtaaccaactaaagaagcaccggctaactctgtgccagcagccgcggtaatacagagggtgcgagcgttaatcggaattactgggcgtaaagcgcgcgtaggcggcttttcaagtcgattgtgaaatccccgggcttaacctgggaactgcagtcgagactgtctagctagagtatgggagagggaagtggaatttcaggtgtagcggtgaaatgcgtagatatctgaaggaacatcagtggcgaaagcgacttcctggaccaatactgacgctcatgtgcgaaagcgtggggagcaaacaggattagataccctggtagtccacgccataaacgatgagaactggatgtcggaggggtctgcccttcggtgtcgtagctaacgcgttaagttctccgcctggggagtacggccgcaaggttgaaactcaaaggaattgacggggacccgcacaagcggtggagcatgtggtttaattcgatgcaacgcgaagaaccttacctggtcttgacatcctaggaatcctgcagagatgtgggagtgccttcgggaacctggagacaggtgctgcatggctgtcgtcagctcgtgtcgtgagatgttgggttaagtcccgcaacgagcgcaacccttgcccttagttgccagcatttaggtgggaactctaaggggaccgccggtgacaaaccggaggaaggtggggatgacgtcaagtcatcatggcccttatgaccagggctacacacgtgctacaatggccagtacaaagggttgccaacccgcgagggggagccaatcccaaaaagctggtcgtagtccggatcgcagtctgcaactcggctgcgtgaagtcggaatcgctagtaatcgtgaatcagcgatgtcacggtgaatacgttcccgggtcttgtacacaccgcccgtcacaccatgggagttgattgcaccagaagtaggtagcctaaccgcaaggagggcgcttaccacggtgtggtcaatgactggggtgaagtcgtaacaaggtagccgtacgggaacgtgcggctggatcacctcctttaaa

SEQ ID NO: 9063 - DNA, 1556 bp, Sterolibacteriaceae bacterium J5B
  ref <308>: DATABASE ACCESSION NUMBER: NCBI ACCESSION: NZ_AP018718.1
  ref <309>: DATABASE ENTRY DATE: 2019-04-01
  ref <313>: RELEVANT RESIDUES IN SEQ ID NO: (1)..(1556)
agattgaactgaagagtttgatcctggctcagattgaacgctggcggaatgctttacacatgcaagtcgggcggcagcgcgggactcaggcaactgagttctggcggcgagcggcgaacgggtgagtaacacatcggaacgtacccagttgtgggggatagcccggcgaaagccggattaataccgcatacgacctgagggtgaaagtgggggaccgcaaggcctcacgcaattggagcggccgatggcggattagctagttggtggggtaaaggcccaccaaggcgacgatccgtagctggtctgagaggatgatcagccacactggaactgagacacggtccagactcctacgggaggcagcagtggggaattttggacaatgggcgcaagcctgatccagccattccgcgtgagtgaagaaggccttcgggttgtaaagctctttcggcggggacgaaacggtggaggcgaacaccctctgctaatgacggtacccgaagaagaagcaccggctaactacgtgccagcagccgcggtaatacgtagggtgcgagcgttaatcggaattactgggcgtaaagcgtgcgcaggcggctctataagacagatgtgaaatccctgggctcaacctaggaactgcgtttgtgactgtagagctggagtgcggcagaggggggtggaattccacgtgtagcagtgaaatgcgtagagatgtggaggaacaccgatggcgaaggcagccccctgggttgacactgacgctcatgcacgaaagcgtggggagcaaacaggattagataccctggtagtccacgccctaaacgatgccaactaggtgttggggaaggagactttcttagtaccgaagctaacgcgtgaagttggccgcctggggagtacggtcgcaagattaaaactcaaaggaattgacggggacccgcacaagcggtggatgatgtggattaattcgatgcaacgcgaaaaaccttacctacccttgacatgcctcgaatcctgcagagatgtgggagtgcccgaaagggagcggggacacaggtgctgcatggctgtcgtcagctcgtgtcgtgagatgttgggttaagtcccgcaacgagcgcaacccttgtcattagttgccatcattgagttgggcactctaatgagactgccggtgacaaaccggaggaaggtggggatgacgtcaagtcctcatggcccttatgggtagggcttcacacgtcatacaatggtcggtacagagggtagccaagccgcgaggtggagccaatcccagaaagccgatcgtagtccggattgcagtctgcaactcgactgcatgaagtcggaatcgctagtaatcgcggatcagcatgccgcggtgaatacgttcccgggtcttgtacacaccgcccgtcacaccatgggagtggggttcaccagaagtaggtagcctaaccgcgaggggggcgcttaccacggtgggcttcatgactggggtgaagtcgtaacaaggtagccgtatcggaaggtgcggctggatcacctcctttcta

SEQ ID NO: 9064 - DNA, 1457 bp, Streptacidiphilus pinicola
  ref <308>: DATABASE ACCESSION NUMBER: NCBI ACCESSION: NZ_QKYN01000140.1
  ref <309>: DATABASE ENTRY DATE: 2019-04-01
  ref <313>: RELEVANT RESIDUES IN SEQ ID NO: (1)..(1457)
aacggtgaagcccttcggggtggatcagtggcgaacgggtgagtaacacgtgggcaatctgccctgcactctgggacaagccttggaaacgaggtctaataccggatattacccttgaccgcatggtcttgggtggaaagctccggcggtgcaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgaaggccttcgggttgtaaacctctttcagcagggaagaagcgcaagtgacggtacctgcagaagaagcaccggctaactacgtgccagcagccgcggtaatacgtagggtgcgagcgttgtccggaattattgggcgtaaagagctcgtaggcggcttgtcacgtcggatgtgaaagcccggggcttaaccccgggtctgcattcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggcactaggtgtgggcgacattccacgtcgtccgcgccgcagctaacgcattaagtgccccgcctggggagtacggccgcaaggctaaaactcaaaggaattgacgggggcccgcacaagcagcggagcatgtggcttaattcgacgcaacgcgaagaaccttaccaaggcttgacatacaccggaaacgtccagagatgggcgcccccttgtggtcggtgtacaggtggtgcatggttgtcgtcagctcgtgtcgtgagatgttgggttaagtcccgcaacgagcgcaaccctcgttctgtgttgccagcggttcggccggggactcacaggagactgccggggtcaactcggaggaaggtggggatgacgtcaaatcatcatgccccttatgtcttgggctgcacacgtgctacaatggccggtacaaagagctgcgatgccgtgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcctaaccccttgtgggagggagctgtcgaaggtgggaccagcgattgggacgaagtcgtaacaaggtagccgtaccggaaggtgcggctggatcacctcctttcta

SEQ ID NO: 9065 - DNA, 1533 bp, Streptobacillus felis
  ref <308>: DATABASE ACCESSION NUMBER: NCBI ACCESSION: NZ_LOHX01000042.1
  ref <309>: DATABASE ENTRY DATE: 2019-04-01
  ref <313>: RELEVANT RESIDUES IN SEQ ID NO: (1)..(1533)
aaatatattgaatgaagagtttgatcctggctcaggatgaacgctgacagaatgcttaacacatgcaaatctatgttgagtaactaagcttgcttagatatgagacatggtggactggtgagtaacgtgtaaagaacttgcctcttagactgggataaccattggaaacgatggataatactagatattattagacataggcatctaagtttaatgaaagagagatcactaagagagagctttgcatcctattagctagttggtggggtaaaggcctaccaaggcgatgataggtagccggcccgagagggtgaacggccacaaggggactgagatacggcccttactcctacgggaggcagcagtggggaatattggacaatggaggcaactctgatccagcaattctgtgtgcacgaagacggttttcggattgtaaagtgctttcagtagggaagaagaaagtgacggtacctacagaagaagcgacggctaaatacgtgccagcagccgcggtaatacgtatgtcgcaagcgttatccggaattattgggcttaaagggcatctaggcggtctaacaagttgaaggtgaaaagctgtggctcaaccatagtcttgcctacaaaactgtaagactagagtactggaaaggtgggtggaactacacgagtagaggtgaaattcgtagatatgtgtaggaatgccgatgatgaagataactcactggacagaaactgacgctgaagtgcgaaagctaggggagcaaacaggattagataccctggtagtcctagctgtaaacgatgatcactgggtgtgggggtgcgaaacctctgtgccgaagcaaaagcgataagtgatccgcctggggagtacgtacgcaagtatgaaactcaaaggaattgacggggacccgcacaagtggtggagcatgtggtttaattcgacgcaacgcgaggaaccttaccaggtcttgacatactcggaataagatggaagcatcttagtgccttcgggaaccgagatacaggtggtgcatggctgtcgacagctcgtgtcgtgagatgttgggttaagtcccgcaacgagcgaaacccctatcattagttgccatcattaagttggggactctaatgaaactgcccgcgacgagcgggaggaaggtggggatgacgtcaagtcatcatgccccttatgatctgggctacacacgtgctacaatgggtagtacaaagaggagcgaagcagtgatgtggagcaaatctcaaaagctactctcagttcggattgaagtctgcaactcgacttcatgaagttggaatcactagtaatcgcaaatcagcaatgttgcggtgaatacgttctcgggtcttgtacacaccgcccgtcacaccacgagagttagttgcacctgaagttactggcctaaccgtaaggagggaagtacctaaggtgtgattagtgattggggtgaagtcgtaacaaggtatccgtaccggaaggtgcggatggatcacctcctttctaaggag

SEQ ID NO: 9066 - DNA, 1525 bp, Streptobacillus hongkongensis
  ref <308>: DATABASE ACCESSION NUMBER: NCBI ACCESSION: NZ_LOHY01000113.1
  ref <309>: DATABASE ENTRY DATE: 2019-04-01
  ref <313>: RELEVANT RESIDUES IN SEQ ID NO: (1)..(1525)
aaatattgaatgaagagtttgatcctggctcaggatgaacgctgacagaatgcttaacacatgcaaatctatgaaaagttaactagcttgctagggaatggatcatggtggactggtgagtaacgtgtaaagaacttgccttatagactgggataacagttggaaacgactgataatactagatattatgggattgtggcatcacgatgacatgaaagggagaccgctataagagagctttgcatcctattagctagttggtggggtaaaggcctaccaaggcgatgataggtagccggcccgagagggtgaacggccacaaggggactgagatacggcccttactcctacgggaggcagcagtggggaatattggacaatggaggcaactctgatccagcaattctgtgtgcacgaagaaggttttcggattgtaaagtgctttcagtagggaagaaggaagtgacggtacctacagaagaagcgacggctaaatacgtgccagcagccgcggtaatacgtatgtcgcaagcgttatccggaattattgggcttaaagggcatctaggcggttaaacaagtcaggggtgaaaacttgcagctcaactgcaagcttgcctttgaaactgattaactagagtactggaaaggtgggtggaactacacgagtagaggtgaaattcgtagatatgtgtaggaatgccgatgatgaagataactcactggacagaaactgacgctgaagtgcgaaagctaggggagcaaacaggattagataccctggtagtcctagctgtaaacgatgatcactgggtgtggggatgagaaatctctgtgccgaagcaaaagcgataagtgatccgcctggggagtacgtacgcaagtatgaaactcaaaggaattgacggggacccgcacaagtggtggagcatgtggtttaattcgacgcaacgcgaggaaccttaccaggtcttgacatactcggaatctgttagaagtaacggagtgccttcgggaaccgagatacaggtggtgcatggctgtcgacagctcgtgtcgtgagatgttgggttaagtcccgcaacgagcgaaacccctatcattagttgccatcattaagttggggactctaatgaaactgcctgcgacgagcaggaggaaggtggggatgacgtcaagtcatcatgccccttatgatctgggctacacacgtgctacaatgggtagtacaaagaggagcgaaatagcgatatggagcgaatctcaaaagctactctcagttcggattgaagtctgcaactcgacttcatgaagttggaatcactagtaatcgcaaatcagcaatgttgcggtgaatacgttctcgggtcttgtacacaccgcccgtcacaccacgagagtttgttgcacctgaagttactggcctaaccgtaaggagggaagtacctaaggtgtgataagtgattggggtgaagtcgtaacaaggtatccgtaccggaaggtgcggatggatcacctcctttct

SEQ ID NO: 9067 - DNA, 1526 bp, Streptobacillus moniliformis
  ref <308>: DATABASE ACCESSION NUMBER: NCBI ACCESSION: NZ_CP027400.1
  ref <309>: DATABASE ENTRY DATE: 2019-04-01
  ref <313>: RELEVANT RESIDUES IN SEQ ID NO: (1)..(1526)
aaatattgaatgaagagtttgatcctggctcaggatgaacgctgacagaatgcttaacacatgcaaatctatgtatgaaatgtaagcttgcttacatagactacatggtggactggtgagtaacgtgtaaagaacttacctcttagactgggataaccattagaaatgatggataatactagatattattagtagtaggcatctactattaatgaaaggagagattgctaagagagagctttgcatcctattagctagttggtggggtaaaggcctaccaaggctatgataggtagccggcccgagagggtgaacggccacaaggggactgagatacggcccttactcctacgggaggcagcagtggggaatattggacaatggaggaaactctgatccagcaattctgtgtgcacgaagaaggttttcggattgtaaagtgctttcagtagggaagaagaagatgacggtacctacagaagaagcgacggctaaatacgtgccagcagccgcggtaatacgtatgtcgcaagcgttatccggaattattgggcttaaagggcatctaggcggtctaacaagttgaaggtgaaaagctgtggctcaaccatagtcttgcctacaaaactgtcagactagagtactggaaaggtgggtggaactacacgagtagaggtgaaattcgtagatatgtgtaggaatgccgatgatgaagataactcactggacagaaactgacgctgaagtgcgaaagctaggggagcaaacaggattagataccctggtagtcctagctgtaaacgatgatcactgggtgtgggggtgtgaagcctctgtgccgaagcaaaagcgataagtgatccgcctggggagtacgtacgcaagtatgaaactcaaaggaattgacggggacccgcacaagtggtggagcatgtggtttaattcgacgcaacgcgaggaaccttaccaggtcttgacatactcggaataagatggaagcatcttagtgcctttgggaaccgagatacaggtggtgcatggctgtcgacagctcgtgtcgtgagatgttgggttaagtcccgcaacgagcgaaacccctatcattagttgccatcattaagttggggactctaatgaaactgcccgcgacgagcgggaggaaggtggggatgacgtcaagtcatcatgccccttatgatctgggctacacacgtgctacaatgggtagtacaaagaggagctaagcagtgatgtggagcaaatcttcaaagctactctcagttcggattgaagtctgcaactcgacttcatgaagttggaatcactagtaatcgcaaatcagcaatgttgcggtgaatacgttctcgggtcttgtacacaccgcccgtcacaccacgagagttagttgcacctgaagttactggcctaaccgtaaggagggaagtacctaaggtgtgattagtgattggggtgaagtcgtaacaaggtatccgtaccggaaggtgcggatggatcacctcctttct

SEQ ID NO: 9068 - DNA, 1555 bp, Streptobacillus notomytis
  ref <308>: DATABASE ACCESSION NUMBER: NCBI ACCESSION: NZ_LKKV01000095.1
  ref <309>: DATABASE ENTRY DATE: 2019-04-01
  ref <313>: RELEVANT RESIDUES IN SEQ ID NO: (1)..(1555)
aagaagtaaagaagagatatagagatatattgaatgaagagtttgatcctggctcaggatgaacgctgacagaatgcttaacacatgcaaatctatgttaattatgtaagcttgcttagataagagacatggtggactggtgagtaacgtgtaaagaacttacctcttagactgggataaccattagaaatgatggataatactagatattattagaagtgggcatctacttttaatgaaaggagagattgctaagagagagctttgcatcctattagctagttggtggggtaaaggcctaccaaggcgatgataggtagccggcccgagagggtgaacggccacaaggggactgagatacggcccttactcctacgggaggcagcagtggggaatattggacaatggaggaaactctgatccagcaattctgtgtgcacgaagaaggttttcggattgtaaagtgctttcagtagggaagaagaaagtgacggtacctacagaagaagcgacggctaaatacgtgccagcagccgcggtaatacgtatgtcgcaagcgttatccggaattattgggcttaaagggcatctaggcggtctaacaagttgaaggtgaaaagctgtggctcaaccatagtcttgcctacaaaactgtcagactagagtactggaaaggtgggtggaactacacgagtagaggtgaaattcgtagatatgtgtaggaatgccgatgatgaagataactcactggacagaaactgacgctgaagtgcgaaagctaggggagcaaacaggattagataccctggtagtcctagctgtaaacgatgatcactgggtgtgggggtataagcctctgtgccgaagcaaaagcgataagtgatccgcctggggagtacgtacgcaagtatgaaactcaaaggaattgacggggacccgcacaagtggtggagcatgtggtttaattcgacgcaacgcgaggaaccttaccagatcttgacatactcggaataagatggaagcatcttagtgccttcgggaaccgagatacaggtggtgcatggctgtcgacagctcgtgtcgtgagatgttgggttaagtcccgcaacgagcgaaacccctatcattagttgccatcattaagttggggactctaatgaaactgcccgcgacgagcgggaggaaggtggggatgacgtcaagtcatcatgccccttatgatctgggctacacacgtgctacaatgggtagtacaaagaggagctaagcagtgatgtggagcaaatcttaaaagctactctcagttcggattgaagtctgcaactcgacttcatgaagttggaatcactagtaatcgcaaatcagcaatgttgcggtgaatacgttctcgggtcttgtacacaccgcccgtcacaccacgagagttagttgcacctgaagttactggcctaaccgtaaggagggaagtacctaaggtgtgattagtgattggggtgaagtcgtaacaaggtatccgtaccggaaggtgcggatggatcacctcctttctaaggag

SEQ ID NO: 9069 - DNA, 1538 bp, Streptobacillus ratti
  ref <308>: DATABASE ACCESSION NUMBER: NCBI ACCESSION: NZ_LKKW01000051.1
  ref <309>: DATABASE ENTRY DATE: 2019-04-01
  ref <313>: RELEVANT RESIDUES IN SEQ ID NO: (1)..(1538)
taataaagatattgaatgaagagtttgatcctggctcaggatgaacgctgacagaatgcttaacacatgcaaatcaatgttaattaactaagcttgcttagttaagagacatggtggactggtgagtaacgtgtaaagaacttacctcttagactgggataaccattggaaacgatggataatactagatattattaatataaggcatctaatattaatgaaataatttattgctaagagagagctttgcatcctattagctagttggtggggtaaaggcctaccaaggcgatgataggtagccggcccgagagggtgaacggccacaaggggactgagatacggcccttactcctacgggaggcagcagtggggaatattggacaatggaggcaactctgatccagcaattctgtgtgcacgaagaaggttttcggattgtaaagtgctttcagtagggaagaagaagatgacggtacctacagaagaagcgacggctaaatacgtgccagcagccgcggtaatacgtatgtcgcaagcgttatccggaattattgggcttaaagggcatctaggcggtctaacaagttgaaggtgaaaagctgtggctcaaccatagtcttgcctacaaaactgtcagactagagtactggaaaggtgggtggaactacacgagtagaggtgaaattcgtagatatgtgtaggaatgccgatgatgaagataactcactggacagaaactgacgctgaagtgcgaaagctaggggagcaaacaggattagataccctggtagtcctagctgtaaacgatgatcactgggtgtgggggtgtgaagcctctgtgccgaagcaaaagcgataagtgatccgcctggggagtacgtacgcaagtatgaaactcaaaggaattgacggggacccgcacaagtggtggagcatgtggtttaattcgacgcaacgcgaggaaccttaccaggtcttgacatactcggaataagatggaagcatcttagtgccttcgggaaccgagatacaggtggtgcatggctgtcgacagctcgtgtcgtgagatgttgggttaagtcccgcaacgagcgaaacccctatcattagttgccatcattaagttggggactctaatgaaactgcctgcgacgagcaggaggaaggtggggatgacgtcaagtcatcatgccccttatgatctgggctacacacgtgctacaatgggtagtacaaagaggagctaagcagtgatgtggagcaaatcttcaaagctactctcagttcggattgaagtctgcaactcgacttcatgaagttggaatcactagtaatcgcaaatcagcaatgttgcggtgaatacgttctcgggtcttgtacacaccgcccgtcacaccacgagagttagttgcacctgaagttactggcctaaccgtaaggagggaagtacctaaggtgtgattagtgattggggtgaagtcgtaacaaggtatccgtaccggaaggtgcggatggatcacctcctttctaaggag

SEQ ID NO: 9070 - DNA, 1555 bp, Streptococcus acidominimus
  ref <308>: DATABASE ACCESSION NUMBER: NCBI ACCESSION: NZ_UHEN01000001.1
  ref <309>: DATABASE ENTRY DATE: 2019-04-01
  ref <313>: RELEVANT RESIDUES IN SEQ ID NO: (1)..(1555)
ttgatgagagtttgatcctggctcaggacgaacgctggcggcgtgcctaatacatgcaagtagaacgccaagactttgtacttgtacagagttgaggagttgcgaacgggtgagtaacgcgtaggtaacctgcctggtagcgggggataactattggaaacgatagctaataccgcataatagtgtttactgcatggtaaacatttaaaaggtgcaactgcaccactaccagatggacctgcgttgtattagctagtaggtaaggtaacggcttacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgttagcgggagtggaaaatccgctaagtgacggtaccttaccagaaagggacggctaactacgtgccagcagccgcggtaatacgtaggtcccgagcgttgtccggatttattgggcgtaaagcgagcgcaggcggtttgataagtcagaagtaaaaggctgtggctcaaccatagtacgcttttgaaactgtcaaacttgagtgcagaaggggggagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgtcctagagatagggcttctcttttgagcaggggagacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgcaaggagccagccgcctaaggtgggatagatgattggggtgaagtcgtaacaaggtagccgtatcggaaggtgcggctggatcacctcctttctaaggaa

SEQ ID NO: 9071 - DNA, 1555 bp, Streptococcus agalactiae
  ref <308>: DATABASE ACCESSION NUMBER: NCBI ACCESSION: NZ_LR134520.1
  ref <309>: DATABASE ENTRY DATE: 2019-04-01
  ref <313>: RELEVANT RESIDUES IN SEQ ID NO: (1)..(1555)
ttaatgagagtttgatcctggctcaggacgaacgctggcggcgtgcctaatacatgcaagtagaacgctgaggtttggtgtttacactagactgatgagttgcgaacgggtgagtaacgcgtaggtaacctgcctcatagcgggggataactattggaaacgatagctaataccgcataagagtaattaacacatgttagttatttaaaaggagcaattgcttcactgtgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacgttggtaggagtggaaaatctaccaagtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9072 - DNA, 1560 bp, Streptococcus anginosus
  ref <308>: DATABASE ACCESSION NUMBER: NCBI ACCESSION: NZ_LR134283.1
  ref <309>: DATABASE ENTRY DATE: 2019-04-01
  ref <313>: RELEVANT RESIDUES IN SEQ ID NO: (1)..(1560)
atgagagtttgatcctggctcaggacgaacgctggcggcgtgcctaatacatgcaagtaggacgcacagtttataccgtagcttgctacaccatagactgtgagttgcgaacgggtgagtaacgcgtaggtaacctgcctattagagggggataactattggaaacgatagctaataccgcataacagtatgtaacacatgttagatgcttgaaagatgcaattgcatcgctagtagatggacctgcgttgtattagctagtaggtagggtaatggcctacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgagtgtgagaatggaaagttcatactgtgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagataggaagtttcttcggaacatcggtgacaggtggtgcatggttgtcgtcagctcgtgtcgtgagatgttgggttaagtcccgcaacgagcgcaacccttattgttagttgccatcattaagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9073 - DNA, 1555 bp, Streptococcus australis
  ref <308>: DATABASE ACCESSION NUMBER: NCBI ACCESSION: NZ_LS483444.1
  ref <309>: DATABASE ENTRY DATE: 2019-04-01
  ref <313>: RELEVANT RESIDUES IN SEQ ID NO: (1)..(1555)
ttaatgagagtttgatcctggctcaggatgaacgctggcggcgtgcctaatacatgcaagtagaacgctgaaggaaggagcttgctctttccggatgagttgcgaacgggtgagtaacgcgtaggtaacctgcctggtagcgggggataactattggaaacgatagctaataccgcataacagtagatgttgcatgatatttacttgaaaggggcaattgctccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgatcgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9074 - DNA, 1554 bp, Streptococcus azizii
  ref <308>: DATABASE ACCESSION NUMBER: NCBI ACCESSION: NZ_MSPS01000036.1
  ref <309>: DATABASE ENTRY DATE: 2019-04-01
  ref <313>: RELEVANT RESIDUES IN SEQ ID NO: (1)..(1554)
ttaatgagagtttgatcctggctcaggacgaacgctggcggcgtgcctaatacatgcaagtagaacgctaaaaggagagcttgctcttctggaagagttgcgaacgggtgagtaacgcgtaggtaacctgcctggtagcgggggataactattggaaacgatagctaataccgcataatagaggatgacacatgttatctttttgaaagaagcaagtgcttcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgttagcgggagtggaaaatccgctaagtgacggtaccttaccagaaagggacggctaactacgtgccagcagccgcggtaatacgtaggtcccgagcgttgtccggatttattgggcgtaaagcgagcgcaggcggtttgataagtcagaagtaaaaggctgtggctcaaccatagtacgcttttgaaactgtcaaacttgagtgcagaaggggggagtggaattccatgtgtagcggtgaaatgcgtagatatatggaggaacaccggtggcgaaagcggctctctggtctgtaactgacgctgaggctcgaaagcgtgggtagcgaacaggattagataccctggtagtccacgccgtaaacgatgagtgctaggtgttgggtcctttccgggactcagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgtcctagagataggattttccttcgggacagaggagacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgttacggagccagccgcctaaggtgggatagatgattggggtgaagtcgtaacaaggtagccgtatcggaaggtgcggctggatcacctcctttctaaggaa

SEQ ID NO: 9075 - DNA, 1554 bp, Streptococcus bovimastitidis
  ref <308>: DATABASE ACCESSION NUMBER: NCBI ACCESSION: NZ_LZDD01000001.1
  ref <309>: DATABASE ENTRY DATE: 2019-04-01
  ref <313>: RELEVANT RESIDUES IN SEQ ID NO: (1)..(1554)
aatgagagtttgatcctggctcaggacgaacgctggcggcgtgcctaatacatgcaagtagaacgctgaggtctggtgcttgcactagaccaaggagttgcgaacgggtgagtaacgcgtaggtaacctacctcatagcgggggataactattggaaacgatagctaataccgcatgacaatagagtacacatgtacttaatttaaaaggggcaactgctccactatgagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttagagaagaacggtaatgggagtggaaaatccattacgtgacggtaactaaccagaaagggacggctaactacgtgccagcagccgcggtaatacgtaggtctcgagcgttgtccggatttattgggcgtaaagcgagcgcaggcggtttgataagtctgaagttaaaggctgtggcttaaccatagtatgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccgtcctagagataggatttcccttcggggcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9076 - DNA, 1410 bp, Streptococcus caballi
  ref <308>: DATABASE ACCESSION NUMBER: NCBI ACCESSION: NZ_KB904115.1
  ref <309>: DATABASE ENTRY DATE: 2019-04-01
  ref <313>: RELEVANT RESIDUES IN SEQ ID NO: (1)..(1410)
ataactattggaaacgatagctaataccgcataacagttgataactcatgttattagcttgaaagatgcaacagcatcactacgagatggacctgcgttgtattagctagttggtgaggtaaaggctcaccaaggccacgatacatagccgacctgagagggtgatcggccacattgggactgagacacggcccaaactcctacgggaggcagcagtagggaatcttcggcaatgggggcaaccctgaccgagcaacgccgcgtgagtgaagaaggttttcggatcgtaaagctctgttgtaagagaagaacgttgatgagagtggaaaattcatcaagtgacggtatcttaccagaaagggacggctaactacgtgccagcagccgcggtaatacgtaggtcccgagcgttgtccggatttattgggcgtaaagcgagcgcaggcggtttcgtaagtctgaagttaaaggcagtggctcaaccattgttcgctttggaaactgcgagacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttttgtacatcggtgacaggtggtgcatggttgtcgtcagctcgtgtcgtgagatgttgggttaagtcccgcaacgagcgcaacccctattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9077 - DNA, 1556 bp, Streptococcus canis
  ref <308>: DATABASE ACCESSION NUMBER: NCBI ACCESSION: NZ_LR134293.1
  ref <309>: DATABASE ENTRY DATE: 2019-04-01
  ref <313>: RELEVANT RESIDUES IN SEQ ID NO: (1)..(1556)
ttaaagagagtttgatcctggctcaggacgaacgctggcggcgtgcctaatacatgcaagtagaacgctgaggacaggtgcttgcactagtctaaggagttgcgaacgggtgagtaacgcgtaggtaacctacctgatagcgggggataactattggaaacgatagctaataccgcataaaagtgcttaacacatgttaagaacttaaaaggggcaactgctccactatgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttagagaagaacggtaatgggagtggaaaacccattatgtgacggtaactaaccagaaagggacggctaactacgtgccagcagccgcggtaatacgtaggtcccgagcgttgtccggatttattgggcgtaaagcgagcgcaggcggttctttaagtctgaagttaaaggcattggctcaaccaatgtatgctttggaaactggagaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctctgaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaacctattaggagccagccgcctaaggtgggatagatgattggggtgaagtcgtaacaaggtagccgtatcggaaggtgcggctggatcacctcctttctaaggaa

SEQ ID NO: 9078 - DNA, 1527 bp, Streptococcus castoreus
  ref <308>: DATABASE ACCESSION NUMBER: NCBI ACCESSION: NZ_AUKZ01000044.1
  ref <309>: DATABASE ENTRY DATE: 2019-04-01
  ref <313>: RELEVANT RESIDUES IN SEQ ID NO: (1)..(1527)
ttaatgagagtttgatcctggctcaggacgaacgctggcggcgtgcctaatacatgcaagtagaacgctgaggactggtgcttgcactagtctgaggagttgcgaacgggtgagtaacgcgtaggtaacctaccttttagcgggggataactattggaaacgatagctaataccgcataagaccgaaagtcacatgacaagcggttgaaaggaacaaaagtttcactaagagatggacctgcgttgtattagctagttggtaaggtaacggcttaccaaggcgacgatacatagccgacctgagagggtgaacggccacactgggactgagacacggcccagactcctacgggaggcagcagtagggaatcttcggcaatggggggaaccctgaccgagcaacgccgcgtgagtgaagaaggttttcggatcgtaaagctctgttgttagagaagaacggtaatgggagtggaaaatccattacgtgacggtacctaacgagaaagggacggctaactacgtgccagcagccgcggtaatacgtaggtcccgagcgttgtccggatttattgggcgtaaagcgagcgcaggcggttgtataagtctgaagtaaaaggctatggcttaaccatagtatgctttggaaactgtgcaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccgtcctagagataggatttcccttcggggcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctctgaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgttaaggagccagccgcctaaggtgggatagatgattggggtgaagtcgtaacaaggtagccgtatcggaagg

SEQ ID NO: 9079 - DNA, 1560 bp, Streptococcus constellatus
  ref <308>: DATABASE ACCESSION NUMBER: NCBI ACCESSION: NZ_UHFC01000002.1
  ref <309>: DATABASE ENTRY DATE: 2019-04-01
  ref <313>: RELEVANT RESIDUES IN SEQ ID NO: (1)..(1560)
atgagagtttgatcctggctcaggacgaacgctggcggcgtgcctaatacatgcaagtagaacgcacaggatgcaccgtagtttactacaccgtattctgtgagttgcgaacgggtgagtaacgcgtaggtaacctgcctggtagcgggggataactattggaaacgatagctaataccgcataagaacatttactgcatggtagatgtttaaaaggtgcaagagcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgtgtgtgagagtggaaagttcacacagtgacggtacttaaccagaaagggacggctaactacgtgccagcagccgcggtaatacgtaggtcccgagcgttgtccggatttattgggcgtaaagcgagcgcaggcggttagataagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccactctagagatagagtttcccttcggggcagaggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9080 - DNA, 1564 bp, Streptococcus criceti
  ref <308>: DATABASE ACCESSION NUMBER: NCBI ACCESSION: NZ_UHFB01000004.1
  ref <309>: DATABASE ENTRY DATE: 2019-04-01
  ref <313>: RELEVANT RESIDUES IN SEQ ID NO: (1)..(1564)
ttaatgagagtttgatcctggctcaggacgaacgctggcggcgtgcctaatacatgcaagtggaacgcttcttttttaccgagtgcttgcactcacaaggaagaagagtcgcgaacgggtgagtaacgcgtaggtaacctgcctggtagcgggggataactattggaaacgatagctaataccgcataacaatggataacacatgttattgatttaaaaggtgcaatggcaccactatcagatggacctgcgttgtattagctagtaggtagggtaaaggcctacctaggctgcgatacatagccgacctgagagggtgaacggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgttgagtagagtggaaagttactcaagtgacggtatcttaccagaaagggacggctaactacgtgccagcagccgcggtaatacgtaggtcccgagcgttgtccggatttattgggcgtaaagcgagcgcaggcggtttagtaagtctgaagttaaaggcattggctcaaccaatgtttgctttggaaactgttaaacttgagtgcagaaggggagagtggaattccatgtgtagcggtgaaatgcgtagatatatggaggaacaccggtggcgaaagcggctctctggtctgtaactgacgctgaggctcgaaagcgtgggtagcgaacaggattagataccctggtagtccacgccgtaaacgctgagtgctaggtgttgggtcctttccgggactcagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgccatccctagagatagggagttacttcggtacatcggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctctgaaagccaatctcagttcggattggaggctgcaactcgcctccatgaagtcggaatcgctagtaatcgcggatcagcacgccgcggtgaatacgttcccgggccttgtacacaccgcccgtcacaccacgagagtttgtaacacccaaagtcggtgaggtaaccttcgggagccagccgcctaaggtgggacggatgattggggtgaagtcgtaacaaggtagccgtatcggaaggtgcggctggatcacctcctttctaaggaa

SEQ ID NO: 9081 - DNA, 1556 bp, Streptococcus cristatus
  ref <308>: DATABASE ACCESSION NUMBER: NCBI ACCESSION: NZ_LS483471.1
  ref <309>: DATABASE ENTRY DATE: 2019-04-01
  ref <313>: RELEVANT RESIDUES IN SEQ ID NO: (1)..(1556)
ttaatgagagtttgatcctggctcaggacgaacgctggcggcgtgcctaatacatgcaagtagaacgctgaaggaaggagcttgctctttccggaagagttgcgaacgggtgagtaacgcgtaggtaacctaccttttagcgggggataactattggaaacgatagctaataccgcataagacattttactgcatggtaagatgttaaaagatgcaaatgcatcactaagagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccggtgcccgtcctagagataggattttgcttcggcacaccggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9082 - DNA, 1553 bp, Streptococcus cuniculi
  ref <308>: DATABASE ACCESSION NUMBER: NCBI ACCESSION: NZ_MSJM01000016.1
  ref <309>: DATABASE ENTRY DATE: 2019-04-01
  ref <313>: RELEVANT RESIDUES IN SEQ ID NO: (1)..(1553)
aatgagagtttgatcctggctcaggacgaacgctggcggcgtgcctaatacatgcaagtagaacgctgaaaactttagcttgctagagttggaagagttgcgaacgggtgagtaacgcgtaggtaacctgcctggtagcgggggataactattggaaacgatagctaataccgcataatagtgcttactgcatggtaagtgcttgaaaggtgcaattgcatcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgttagcgggagtggaaaatccgctaagtgacggtaacttaccagaaagggacggctaactacgtgccagcagccgcggtaatacgtaggtcccgagcgttgtccggatttattgggcgtaaagcgagcgcaggcggtttgataagtcagaagtaaaaggctgtggctcaaccatagtacgcttttgaaactgtcaaacttgagtgcagaaggggggagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccagtgaccgttctagagatagaacttttcttcggaacactggtgacaggtggtgcatggttgtcgtcagctcgtgtcgtgagatgttgggttaagtcccgcaacgagcgcaacccctattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9083 - DNA, 1459 bp, Streptococcus didelphis
  ref <308>: DATABASE ACCESSION NUMBER: NCBI ACCESSION: NZ_KB904191.1
  ref <309>: DATABASE ENTRY DATE: 2019-04-01
  ref <313>: RELEVANT RESIDUES IN SEQ ID NO: (1)..(1459)
gagttgcgaacgggtgagtaacgcgtaggtaacctggctcatagcgggggataactattggaaacgatagctaataccgcatgacactagaatacacctgtattttatttaaaaggggcaaatgctccactatgagatggacctgcgttgtattagctagtaggtagggtaaaggcctacctaggcgacgatacatagccgacctgagagggtgaacggccacactgggactgagacacggcccagactcctacgggaggcagcagtagggaatcttcggcaatggggggaaccctgaccgagcaacgccgcgtgagtgaagaaggttttcggatcgtaaagctctgttgttagagaagaatggtgtagggagtggaaaatcctacacgtgacggtaactaaccagaaagggacggctaactacgtgccagcagccgcggtaatacgtaggtcccgagcgttgtccggatttattgggcgtaaagcgagcgcaggcggtttgataagtctgaagttaaaggccgtggctcaaccatggtatgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctcctgaccggtctagagatagacattcccttaggggcaggagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctcctttctaaggaa

SEQ ID NO: 9084 - DNA, 1562 bp, Streptococcus downei
  ref <308>: DATABASE ACCESSION NUMBER: NCBI ACCESSION: NZ_UHFA01000002.1
  ref <309>: DATABASE ENTRY DATE: 2019-04-01
  ref <313>: RELEVANT RESIDUES IN SEQ ID NO: (1)..(1562)
aatgagagtttgatcctggctcaggacgaacgctggcggcgtgcctaatacatgcaagtggaacgcattgatatcaccggagcttgctccactgatattaatgagtcgcgaacgggtgagtaacgcgtaggtaacctgcctgatagcgggggataactattggaaacgatagctaataccgcatgagagtgtttaacacatgttagagacttaaaagataccattgtatcactatcagatggacctgcgttgtattagctagttggtagggtagcggcctaccaaggcaccgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtagcggaagaacgagtgtaagagtggaaagtttacacagtgacggtacgctaccagaaagggacggctaactacgtgccagcagccgcggtaatacgtaggtcccgagcgttgtccggatttattgggcgtaaagggagcgcaggcggtttagtaagtctgaagttaaaggcattggctcaaccaatgtatgctttggaaactgttagacttgagtgcagaaggggagagtggaattccatgtgtagcggtgaaatgcgtagatatatggaggaacaccggtggcgaaagcggctctctggtctgtcactgacgctgaggctcgaaagcgtgggtagcgaacaggattagataccctggtagtccacgccgtaaacgatgagtgctaggtgttaggtcctttccgggacttagtgccgcagctaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttactttttgtacatcggagacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctctgaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccaaagtcggtgaggtaaccttataggagccagccgcctaaggtgggacagatgattggggtgaagtcgtaacaaggtagccgtatcggaaggtgcggctggatcacctcctttctaagga

SEQ ID NO: 9085 - DNA, 1556 bp, Streptococcus dysgalactiae
  ref <308>: DATABASE ACCESSION NUMBER: NCBI ACCESSION: NZ_LR134316.1
  ref <309>: DATABASE ENTRY DATE: 2019-04-01
  ref <313>: RELEVANT RESIDUES IN SEQ ID NO: (1)..(1556)
ttaatgagagtttgatcctggctcaggacgaacgctggcggcgtgcctaatacatgcaagtagaacgctgaggactggtgcttgcaccggtccaaggagttgcgaacgggtgagtaacgcgtaggtaacctacctcatagcgggggataactattggaaacgatagctaataccgcataaaagtgtttaacacatgttaaacatttaaaagatgcaactgcatcactatgagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaatgatggtgggagtggaaaatccaccatgtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggctcaaccattgtacgctttggaaactggagaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctcctgaccggtctagagataggctttcccttcggggcaggagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaacctattaggagccagccgcctaaggtgggatagatgattggggtgaagtcgtaacaaggtagccgtatcggaaggtgcggctggatcacctcctttctaaggaa

SEQ ID NO: 9086 - DNA, 432 bp, Streptococcus entericus
  ref <308>: DATABASE ACCESSION NUMBER: NCBI ACCESSION: NZ_KB904179.1
  ref <309>: DATABASE ENTRY DATE: 2019-04-01
  ref <313>: RELEVANT RESIDUES IN SEQ ID NO: (1)..(432)
ttgttagttgccatcattaagttgggcactctagcgagactgccggtaacaaaccggaggaaggtggggatgacgtcaaatcatcatgccccttatgacctgggctacacacgtgctacaatggtcggtacaacgagtcgcaagtcggtgacgacaagcaaatctcttaaagccgatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtttggagccagccgcctaaggtgggatagatgattggggtgaagtcgtaacaaggtagccgtatcggaaggtgcggctggatcacctcctttctaaggaa

SEQ ID NO: 9087 - DNA, 1561 bp, Streptococcus equi
  ref <308>: DATABASE ACCESSION NUMBER: NCBI ACCESSION: NZ_LR134273.1
  ref <309>: DATABASE ENTRY DATE: 2019-04-01
  ref <313>: RELEVANT RESIDUES IN SEQ ID NO: (1)..(1561)
ttaaagagagtttgatcctggctcaggacgaacgctggcggcgtgcctaatacatgcaagtggaacgcacagatgatacgtagcttgctacaattatctgtgagtcgcgaacgggtgagtaacgcgtaggtaacctagcttatagcgggggataactattggaaacgatagctaataccgcataaaagccaatgacccatgtcattggcttgaaaggagcaaaagctccactatgagatggacctgcgttgtattagctagttggtagggtaaaggcctaccaaggcgacgatacatagccgacctgagagggtgaacggccacactgggactgagacacggcccagactcctacgggaggcagcagtagggaatcttcggcaatggggggaaccctgaccgagcaacgccgcgtgagtgaagaaggttttcggatcgtaaagctctgttgttagagaagaacagtgatgggagtggaaagtccatcatgtgacggtaactaaccagaaagggacggctaactacgtgccagcagccgcggtaatacgtaggtcccgagcgttgtccggatttattgggcgtaaagcgagcgcaggcggtttgataagtctgaagttaaaggcagtggcttaaccattgtatgctttggaaactgttaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgctgagtgctaggtgttaggccctttccggggcttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctattcttagagataagaagttacttcggtacattggagacaggtggtgcatggttgtcgtcagctcgtgtcgtgagatgttgggttaagtcccgcaacgagcgcaacccttattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctctgaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgttaaggagccagccgcctaaggtgggatagatgattggggtgaagtcgtaacaaggtagccgtatcggaaggtgcggctggatcacctcctttctaaggaa

SEQ ID NO: 9088 - DNA, 1554 bp, Streptococcus equinus
  ref <308>: DATABASE ACCESSION NUMBER: NCBI ACCESSION: NZ_LR134292.1
  ref <309>: DATABASE ENTRY DATE: 2019-04-01
  ref <313>: RELEVANT RESIDUES IN SEQ ID NO: (1)..(1554)
aatgagagtttgatcctggctcaggacgaacgctggcggcgtgcctaatacatgcaagtagaacgctgaagactttagcttgctaaagttggaagagttgcgaacgggtgagtaacgcgtaggtaacctgcctactagcgggggataactattggaaacgatagctaataccgcataacagcatttaacacatgttagatgcttgaaagaagcaattgcttcactagtagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgtgtgtgagagtggaaagttcacacagtgacggtaacttaccagaaagggacggctaactacgtgccagcagccgcggtaatacgtaggtcccgagcgttgtccggatttattgggcgtaaagcgagcgcaggcggtttaataagtctgaagttaaaggcagtggcttaaccattgttcgctttggaaactgttagacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaaacgcgaagaaccttaccaggtcttgacatcccgatgctatttctagagataggaagtttcttcggaacatcggtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcgagtccggtgacggcaagcaaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaagga

SEQ ID NO: 9089 - DNA, 1559 bp, Streptococcus ferus
  ref <308>: DATABASE ACCESSION NUMBER: NCBI ACCESSION: NZ_LS483343.1
  ref <309>: DATABASE ENTRY DATE: 2019-04-01
  ref <313>: RELEVANT RESIDUES IN SEQ ID NO: (1)..(1559)
gagagtttgatcctggctcaggacgaacgctggcggcgtgcctaatacatgcaagtggaacgcatgatggataccggagcttgctccaccattcatcatgagtcgcgaacgggtgagtaacgcgtaggtaacctgccttttagcgggggataactattggaaacgatagctaataccgcataagatttagagactcctgtctctggattaaaagatacaatcgtatcgctaagagatggacctgcgttgtattagctagtaggtggggtaaaggcccacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacggtaatgggagtggaaagtccattacgtgacggtacttaaccagaaagggacggctaactacgtgccagcagccgcggtaatacgtaggtcccgagcgttgtccggatttattgggcgtaaagcgagcgcaggcggctctataagtctgaagtgaaaggctatggctcaaccatagtatgctttggaaactgtagggcttgagtgcagaaggggagagtggaattccatgtgtagcggtgaaatgcgtagatatatggaggaacaccggtggcgaaagcggctctctggtctgtgactgacgctgaggctcgaaagcgtgggtagcgaacaggattagataccctggtagtccacgccgtaaacgctgagtgctaggtgttaggccctttccggggcttagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgtcctagagataggattttacttcggtacatcggagacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctctgaaagccaatctcagttcggattggaggctgcaactcgcctccatgaagtcggaatcgctagtaatcgcggatcagcacgccgcggtgaatacgttcccgggccttgtacacaccgcccgtcacaccacgagagtttataacacccgaagtcggtgaggtaaccattatggagccagccgcctaaggtgggatagatgattggggtgaagtcgtaacaaggtagccgtatcggaaggtgcggctggatcacctcctttctaaggaa

SEQ ID NO: 9090 - DNA, 1554 bp, Streptococcus gallolyticus
  ref <308>: DATABASE ACCESSION NUMBER: NCBI ACCESSION: NZ_LS483409.1
  ref <309>: DATABASE ENTRY DATE: 2019-04-01
  ref <313>: RELEVANT RESIDUES IN SEQ ID NO: (1)..(1554)
aatgagagtttgatcctggctcaggacgaacgctggcggcgtgcctaatacatgcaagtagaacgctgactactttagcttgctagagtagaaggagttgcgaacgggtgagtaacgcgtaggtaacctgcctactagcgggggataactattggaaacgatagctaataccgcataacagtgtttaacacatgttagatgcttgaaagatgcaaatgcatcactagtagatggacctgcgttgtattagctagttggtggggtaacggcctaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgtgtgtgagagtggaaagttcacacagtgacggtaacttaccagaaagggacggctaactacgtgccagcagccgcggtaatacgtaggtcccgagcgttgtccggatttattgggcgtaaagcgagcgcaggcggtttaataagtctgaagttaaaggcagtggcttaaccattgttcgctttggaaactgttaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagtttcttcggaacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagtcgcaagtcggtgacggcaagcaaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9091 - DNA, 1562 bp, Streptococcus gordonii
  ref <308>: DATABASE ACCESSION NUMBER: NCBI ACCESSION: NZ_LR134291.1
  ref <309>: DATABASE ENTRY DATE: 2019-04-01
  ref <313>: RELEVANT RESIDUES IN SEQ ID NO: (1)..(1562)
aatgagagtttgatcctggctcaggacgaacgctggcggcgtgcctaatacatgcaagtagaacgcacagtttataccgtagcttgctacaccatagactgtgagttgcgaacgggtgagtaacgcgtaggtaacctgcctggtagcgggggataactattggaaacgatagctaataccgcataatattaattattgcatgataattgattgaaagatgcaactgcatcactaccagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtaagagaagaacgggtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9092 - DNA, 1555 bp, Streptococcus halitosis
  ref <308>: DATABASE ACCESSION NUMBER: NCBI ACCESSION: NZ_QEMY02000001.1
  ref <309>: DATABASE ENTRY DATE: 2019-04-01
  ref <313>: RELEVANT RESIDUES IN SEQ ID NO: (1)..(1555)
ttaatgagagtttgatcctggctcaggacgaacgctggcggcgtgcctaatacatgcaagtagaacgctgaagagaggagcttgctcttcttggatgagttgcgaacgggtgagtaacgcgtaggtaacctgcctggtagcgggggataactattggaaacgatagctaataccgcataaaatggattatcgcatgataatgcattgaaaggtgcaaatgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgatcgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9093 - DNA, 1566 bp, Streptococcus halotolerans
  ref <308>: DATABASE ACCESSION NUMBER: NCBI ACCESSION: NZ_CP014835.1
  ref <309>: DATABASE ENTRY DATE: 2019-04-01
  ref <313>: RELEVANT RESIDUES IN SEQ ID NO: (1)..(1566)
ttaatgagagtttgatcctggctcaggacgaacgctggcggcgtgcctaatacatgcaagtggaacgcattgataactaccgtagcttgctacacttgatatcaatgagtcgcgaacgggtgagtaacgcgtaggtaacctacctttaagcgggggataactattggaaacgatagctaataccgcataatagtggcggacacatgtcagctacttaaaaggtgcaagtgcaccacttaaagatggacctgcgttgtattagctagttggtaaggtaacggcttaccaaggcttcgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttataagcgaagaacgggagtaagagtggaaagtttactctgtgacggtagcttatcagaaagggacggctaactacgtgccagcagccgcggtaatacgtaggtcccgagcgttgtccggatttattgggcgtaaagcgagcgcaggtggtttaataagtctgaagttaaaggcagtggctcaaccattgtacgctttggaaactgttaaacttgagtgcagaaggggagagtggaattccatgtgtagcggtgaaatgcgtagatatatggaggaacaccggtggcgaaagcggctctctggtctgtaactgacactgaggctcgaaagcgtgggtagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccggtgaccgtcctagagataggatttttcttcggaacactggagacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggtcggtacaacgagttgcgaactggtgacagtcagctaatctcttaaagccgatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaacctattaggagccagccgcctaaggtgggatggatgattggggtgaagtcgtaacaaggtagccgtatcggaaggtgcggctggatcacctcctttctaaggaa

SEQ ID NO: 9094 - DNA, 1562 bp, Streptococcus henryi
  ref <308>: DATABASE ACCESSION NUMBER: NCBI ACCESSION: NZ_FMXP01000053.1
  ref <309>: DATABASE ENTRY DATE: 2019-04-01
  ref <313>: RELEVANT RESIDUES IN SEQ ID NO: (1)..(1562)
aatgagagtttgatcctggctcaggacgaacgctggcggcgtgcctaatacatgcaagtggaacgcatgattgataccgtagcttgctacaccattaatcatgagtcgcgaacgggtgagtaacgcgtaggtaacctgcctactagcgggggataactattggaaacgatagctaataccgcataagagtttttaacacatgttagaaatttaaaaggagcaaatgcttcactagtagatggacctgcgttgtattagctagttggtaaggtaacggcttaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgttgagtagagtggaaagttactcaagtgacggtatcttaccagaaagggacggctaactacgtgccagcagccgcggtaatacgtaggtcccgagcgttgtccggatttattgggcgtaaagcgagcgcaggcggctctgtaagtctgaagttaaaggcattggctcaaccaatgttcgctttggaaactgcagggcttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccagtgaccgtcctagagataggatttcccttcggggcactggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaacctattaggagccagccgcctaaggtgggatagatgattggggtgaagtcgtaacaaggtagccgtatcggaaggtgcggctggatcacctcctttctaaggaa

SEQ ID NO: 9095 - DNA, 1553 bp, Streptococcus himalayensis
  ref <308>: DATABASE ACCESSION NUMBER: NCBI ACCESSION: NZ_CP016953.1
  ref <309>: DATABASE ENTRY DATE: 2019-04-01
  ref <313>: RELEVANT RESIDUES IN SEQ ID NO: (1)..(1553)
aatgagagtttgatcctggctcaggacgaacgctggcggcgtgcctaatacatgcaagtagaacgctgaagcttggtgcttgcaccgagcggaggagttgcgaacgggtgagtaacgcgtaggtaacctgcctggtagcgggggataactattggaaacgatagctaataccgcataatagtgcttactgcatggtaagcatttgaaagatgcaattgcatcactaccagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacagcgatgggagtggaaaatccattgtatgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccttattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9096 - DNA, 1343 bp, Streptococcus hongkongensis
  ref <308>: DATABASE ACCESSION NUMBER: NCBI ACCESSION: NZ_JRYN01000003.1
  ref <309>: DATABASE ENTRY DATE: 2019-04-01
  ref <313>: RELEVANT RESIDUES IN SEQ ID NO: (1)..(1343)
gggcaaatgcttcactatgagatggacctgcgttgtattagctagttggtaaggtaacggcttaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttagagaagaacggtaatgggagtggaaaatccattacgtgacggtaactaaccagaaagggacggctaactacgtgccagcagccgcggtaatacgtaggtcccgagcgttgtccggatttattgggcgtaaagcgagcgcaggcggtttgataagtctgaagttaaaggctgtggcttaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgccgctctagagatagagctttacttcggtacatcggtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9097 - DNA, 1554 bp, Streptococcus hyointestinalis
  ref <308>: DATABASE ACCESSION NUMBER: NCBI ACCESSION: NZ_UHFN01000007.1
  ref <309>: DATABASE ENTRY DATE: 2019-04-01
  ref <313>: RELEVANT RESIDUES IN SEQ ID NO: (1)..(1554)
aatgagagtttgatcctggctcaggacgaacgctggcggcgtgcctaatacatgcaagtagaacgctgaaggagggagcttgcttcttctggatgagttgcgaacgggtgagtaacgcgtaggtaacctgcctgatagcgggggataactattggaaacgatagctaataccgcataagaggtaataacacatgttattagtttaaaaggggcaactgctccactatcagatggacctgcgttgtattagctagttggtaaggtaacggcttaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacggatgtgggagtggaaaatccatgtcgtgacggtatcttaccagaaagggacggctaactacgtgccagcagccgcggtaatacgtaggtcccgagcgttgtccggatttattgggcgtaaagcgagcgcaggcggtttcataagtctgaagttaaaggcagtggcttaaccattgtacgctttggaaactgtgagacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagtttttcttcggaacatcggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9098 - DNA, 1415 bp, Streptococcus hyovaginalis
  ref <308>: DATABASE ACCESSION NUMBER: NCBI ACCESSION: NZ_ATVP01000036.1
  ref <309>: DATABASE ENTRY DATE: 2019-04-01
  ref <313>: RELEVANT RESIDUES IN SEQ ID NO: (1)..(1415)
gagtaacgcgtaggtaacctgcctgatagcgggggataactattggaaacgatagctaataccgcataagagtcgttaacacatgttaatgatttaaaaggagcaattgcttcactatcagatggacctgcgttgtattagctagttggtgaggtaacggctcaccaaggcttcgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttataagcgaagaacgggagtaagagtggaaagtttactctgtgacggtagcttatcagaaagggacggctaactacgtgccagcagccgcggtaatacgtaggtcccgagcgttgtccggatttattgggcgtaaagcgagcgcaggtggtttaataagtctgaagttaaaggcattggctcaaccaatgtacgctttggaaactgttgaacttgagtgcagaaggggagagtggaattccatgtgtagcggtgaaatgcgtagatatatggaggaacaccggtggcgaaagcggctctctggtctgtaactgacactgaggctcgaaagcgtgggtagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccagtgaccatcctagagataggatttcccttcggggcactggtgacaggtggtgcatggttgtcgtcagctcgtgtcgtgagatgttgggttaagtcccgcaacgagcgcaacccctattgttagttgccatcattgagttgggcactctagcgagactgccggtaataaaccggaggaaggtggggatgacgtcaaatcatcatgccccttatgacctgggctacacacgtgctacaatggtcggtacaacgagttgcgagctggtgacagtaagctaatctcttaaagccgatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaagg

SEQ ID NO: 9099 - DNA, 1554 bp, Streptococcus ictaluri
  ref <308>: DATABASE ACCESSION NUMBER: NCBI ACCESSION: NZ_AEUX02000007.1
  ref <309>: DATABASE ENTRY DATE: 2019-04-01
  ref <313>: RELEVANT RESIDUES IN SEQ ID NO: (1)..(1554)
aatgagagtttgatcctggctcaggacgaacgctggcggcgtgcctaatacatgcaagtagaacgctgaggactggtgcttgcactagtccaaggagttgcgaacgggtgagtaacgcgtaggtaacctacctcatagcgggggataactattggaaacgatagctaataccgcatgacaattaagtacacatgtactaaatttaaaaggggcaattgcttcactatgagatggacctgcgttgtattagctagttggtgaggtaacggctcaccaaggccacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacggtaatgggagtggaaaatccattacgtgacggtaactaaccagaaagggacggctaactacgtgccagcagccgcggtaatacgtaggtcccgagcgttgtccggatttattgggcgtaaagcgagcgcaggcggttctttaagtctgaagttaaaggcattggctcaaccaatgtacgctttggaaactggagaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9100 - DNA, 1553 bp, Streptococcus infantarius
  ref <308>: DATABASE ACCESSION NUMBER: NCBI ACCESSION: NZ_UHFP01000001.1
  ref <309>: DATABASE ENTRY DATE: 2019-04-01
  ref <313>: RELEVANT RESIDUES IN SEQ ID NO: (1)..(1553)
aatgagagtttgatcctggctcaggacgaacgctggcggcgtgcctaatacatgcaagtagaacgctgaaaactttagcttgctaaagtttgaagagttgcgaacgggtgagtaacgcgtaggtaacctgcctactagcgggggataactattggaaacgatagctaataccgcataacagcatttaacccatgttagatgcttgaaaggagcaattgcttcactagtagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaatgtgtgtgagagtggaaagttcacacagtgacggtaacttaccagaaagggacggctaactacgtgccagcagccgcggtaatacgtaggtcccgagcgttgtccggatttattgggcgtaaagcgagcgcaggcggtttaataagtctgaagttaaaggcagtggcttaaccattgttcgctttggaaactgttagacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctattcctagagataggaagtttcttcggaacatcggtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcgagtcggtgacggcaagcaaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9101 - DNA, 1552 bp, Streptococcus infantis
  ref <308>: DATABASE ACCESSION NUMBER: NCBI ACCESSION: NZ_UHFU01000006.1
  ref <309>: DATABASE ENTRY DATE: 2019-04-01
  ref <313>: RELEVANT RESIDUES IN SEQ ID NO: (1)..(1552)
ttaatgagagtttgatcctggctcaggacgaacgctggcggcgtgcctaatacatgcaagtagaacgctgaaggaggagcttgcttctccggatgagttgcgaacgggtgagtaacgcgtaggtaacctgcctggtagcgggggataactattggaaacgatagctaataccgcataacagtagatatcgcatgatagctgcttgaaaggtgcaattgcaccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgaagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctcctttctaagga

SEQ ID NO: 9102 - DNA, 1561 bp, Streptococcus intermedius
  ref <308>: DATABASE ACCESSION NUMBER: NCBI ACCESSION: NZ_UZBH01000002.1
  ref <309>: DATABASE ENTRY DATE: 2019-04-01
  ref <313>: RELEVANT RESIDUES IN SEQ ID NO: (1)..(1561)
aatgagagtttgatcctggctcaggacgaacgctggcggcgtgcctaatacatgcaagtagaacgcacaggatgcaccgtagtttactacaccgtattctgtgagttgcgaacgggtgagtaacgcgtaggtaacctgcctggtagcgggggataactattggaaacgatagctaataccgcataagaacatttactgcatggtagatgtttaaaaggtgcaaatgcatcactaccagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgagtgtgagaatggaaagttcatactgtgacggtacttaaccagaaagggacggctaactacgtgccagcagccgcggtaatacgtaggtcccgagcgttgtccggatttattgggcgtaaagcgagcgcaggcggttagataagtctgaagttaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagctttacttcggtacatcggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9103 - DNA, 1553 bp, Streptococcus lutetiensis
  ref <308>: DATABASE ACCESSION NUMBER: NCBI ACCESSION: NZ_LS483403.1
  ref <309>: DATABASE ENTRY DATE: 2019-04-01
  ref <313>: RELEVANT RESIDUES IN SEQ ID NO: (1)..(1553)
aatgagagtttgatcctggctcaggacgaacgctggcggcgtgcctaatacatgcaagtagaacgctgaagactttagcttgctaaagttggaagagttgcgaacgggtgagtaacgcgtaggtaacctgcctactagcgggggataactattggaaacgatagctaataccgcataacagcatttaacccatgttagatgcttgaaaggagcaattgcttcactagtagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgtgtgtgagagtggaaagttcacacagtgacggtaacttaccagaaagggacggctaactacgtgccagcagccgcggtaatacgtaggtcccgagcgttgtccggatttattgggcgtaaagcgagcgcaggcggtttaataagtctgaagttaaaggcagtggcttaaccattgttcgctttggaaactgttagacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctattcctagagataggaagtttcttcggaacatcggtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcgagtcggtgacggcaagcaaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaagtaaccttttaggagccagccgcctaaggtgggatagatgattggggtgaagtcgtaacaaggtagccgtatcggaaggtgcggctggatcacctcctttctaagga

SEQ ID NO: 9104 - DNA, 1551 bp, Streptococcus macacae
  ref <308>: DATABASE ACCESSION NUMBER: NCBI ACCESSION: NZ_UHFV01000002.1
  ref <309>: DATABASE ENTRY DATE: 2019-04-01
  ref <313>: RELEVANT RESIDUES IN SEQ ID NO: (1)..(1551)
gagagtttgatcctggctcaggacgaacgctggcggcgtgcctaatacatgcaagtggaacgctgtttctgagttagcttgctaactgagacggcgtcgcgaacgggtgagtaacgcgtaggtaacctgcctcttagagggggataaggattggaaacgataggtaataccgcataatatctctctaagcctttagagggattgaaaggtacaacagtatcgctaagagatggacctgcgttgtattagctagttggtaaggtagaggcttaccaaggcgacgatacatagccgacctgagagggtgaccggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagcaagttggagagagtggaaagttctccaattgacggtacttaaccagaaagggacggctaactacgtgccagcagccgcggtaatacgtaggtcccgagcgttgtccggatttattgggcgtaaagggagcgcaggcggtctggaaagtcagtagttaaaagcattggcttaaccaatgtcagctattgaaactgtcagacttgagtacagaaggggagagtggaattccatgtgtagcggtgaaatgcgtagatatatggaggaacaccagtggcgaaagcggctctctggtctgtgactgacgctgaggctcgaaagcgtgggtagcgaacaggattagataccctggtagtccacgccgtaaacgctgagtgctaggtgttaggtcctaaggggcttagtgccgtagctaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatcccggtgccatttctagagataggaagttacttcggtacaccggagacaggtggtgcatggttgtcgtcagctcgtgtcgtgagatgttgggttaagtcccgcaacgagcgcaacccttatggttagttgccatcattgagttgggcactctagccagactgccggtaataaaccggaggaaggtggggatgacgtcaaatcatcatgccccttatgacctgggctacacacgtgctacaatggttggtacaacgagtcgcaagccggtgacggcaagctaatctctgaaagccaatctcagttcggattggaggctgcaactcgcctccatgaagtcggaatcgctagtaatcgcggatcagcacgccgcggtgaatacgttcccgggccttgtacacaccgcccgtcacaccacgagagtttgtaacacccaaagtcggtgaggtaaccgtaaaggagccagccgcctaaggtgggacggatgattggggtgaagtcgtaacaaggtagccgtatcggaaggtgcggctggatcacctcctttctaaggaa

SEQ ID NO: 9105 - DNA, 1554 bp, Streptococcus macedonicus
  ref <308>: DATABASE ACCESSION NUMBER: NCBI ACCESSION: NZ_FLZS01000002.1
  ref <309>: DATABASE ENTRY DATE: 2019-04-01
  ref <313>: RELEVANT RESIDUES IN SEQ ID NO: (1)..(1554)
aatgagagtttgatcctggctcaggacgaacgctggcggcgtgcctaatacatgcaagtagaacgctgaagactttagcttgctagagttggaagagttgcgaacgggtgagtaacgcgtaggtaacctgcctattagtgggggataactattggaaacgatagctaataccgcataatagtgtttaacacatgttagagacttaaaagatgcaattgcatcactagtagatggacctgcgttgtattagctagttggtggggtaacggcctaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgtgtgtgagagtggaaagttcacacagtgacggtaacttaccagaaagggacggctaactacgtgccagcagccgcggtaatacgtaggtcccgagcgttgtccggatttattgggcgtaaagcgagcgcaggcggtttaataagtctgaagttaaaggcagtggcttaaccattgttcgctttggaaactgttaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagtttcttcggaacatcggtgacaggtggtgcatggttgtcgtcagctcgtgtcgtgagatgttgggttaagtcccgcaacgagcgcaacccctattgttagttgccatcattcagttgggcactctagcgagactgccggtgataaaccggaggaaggtggggatgacgtcaaatcatcatgccccttatgacctgggctacacacgtgctacaatggttggtacaacgagtcgcaagccggtgacggcaagcaaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggacagatgattggggtgaagtcgtaacaaggtagccgtatcggaaggtgcggctggatcacctcctttctaaggaa

SEQ ID NO: 9106 - DNA, 1322 bp, Streptococcus marimammalium
  ref <308>: DATABASE ACCESSION NUMBER: NCBI ACCESSION: NZ_KB904348.1
  ref <309>: DATABASE ENTRY DATE: 2019-04-01
  ref <313>: RELEVANT RESIDUES IN SEQ ID NO: (1)..(1322)
ggacctgcgttgtattagctagttggtggggtaacggctcaccaaggctacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagcgaagaacagtgataggagtggaaaatctatcatatgacggtagcttaccagaaagggacggctaactacgtgccagcagccgcggtaatacgtaggtctcgagcgttgtccggatttattgggcgtaaagcgagcgcaggcggttagataagtcagaagttaaaggctgtggctcaaccatagtatgcttttgaaactgtttaacttgagtgcagaaggggagagtggaattccatgtgtagcggtgaaatgcgtagatatatggaggaacaccggtggcgaaagcggctctctggtctgtcactgacgctgaggctcgaaagcgtgggtagcgaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctttgactggtctagagatagactttcccttcggggcagaggagacaggtggtgcatggttgtcgtcagctcgtgtcgtgagatgttgggttaagtcccgcaacgagcgcaacccttattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaacctattaggagccagccgccgaaggtgggatagatgattggggtgaagtcgtaacaaggtagccgtatcggaaggtgcggctggatcacctcctttctaaggaa

SEQ ID NO: 9107 - DNA, 1556 bp, Streptococcus marmotae
  ref <308>: DATABASE ACCESSION NUMBER: NCBI ACCESSION: NZ_CP015196.1
  ref <309>: DATABASE ENTRY DATE: 2019-04-01
  ref <313>: RELEVANT RESIDUES IN SEQ ID NO: (1)..(1556)
ttaatgagagtttgatcctggctcaggacgaacgctggcggcgtgcctaatacatgcaagtagaacgctgaagcttggtgcttgcaccgagcggaggagttgcgaacgggtgagtaacgcgtaggtaacctgcctggtagcgggggataactattggaaacgatagctaataccgcataagagtgctaactgcatggtaagcatttaaaagatgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacagcgatgggagtggaaagtccattgtatgacggtatcttaccagaaagggacggctaactacgtgccagcagccgcggtaatacgtaggtcccgagcgttgtccggatttattgggcgtaaagcgagagcaggcggtttgataagtcagaagtaaaaggctgtggctcaaccatagtatgcttttgaaactgtcgaacttgagtgcagaaggggggagtggaattccatgtgtagcggtgaaatgcgtagatatatggaggaacaccggtggcgaaagcggctctctggtctgtaactgacgctgagtctcgaaagcgtggggagcgaacaggattagataccctggtagtccacgccgtaaacgatgagtgctaggtgttgggtcctttccgggattcagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgatcgctctagagatagagttttccttcgggacagaggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9108 - DNA, 1552 bp, Streptococcus massiliensis
  ref <308>: DATABASE ACCESSION NUMBER: NCBI ACCESSION: NZ_UHFR01000005.1
  ref <309>: DATABASE ENTRY DATE: 2019-04-01
  ref <313>: RELEVANT RESIDUES IN SEQ ID NO: (1)..(1552)
atgagagtttgatcctggctcaggatgaacgctggcggcgtgcctaatacatgcaagtagaacgcagaggattggtgcttgcactaatctaatgagttgcgaacgggtgagtaacgcgtaggtaacctgcctggtagcgggggataactattggaaacgatagctaataccgcataatagtttatgactcatgttataaacttgaaagatacaactgtatcactaccagatggacctgcgttgtattagctagtaggtagggtaacggcctacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgggagtaggagtggaaagcctactttgtgacggtacttaaccagaaagggacggctaactacgtgccagcagccgcggtaatacgtaggtcccgagcgttatccggatttattgggcgtaaagcgagcgcaggcggttagataagtctggagtaaaaggctatggctcaaccatagtgtgctctggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggccctttccggggcttagtgccgtagctaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgtcctagagataggattttacttcggtacatcggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagtcggtgacgacaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9109 - DNA, 1563 bp, Streptococcus merionis
  ref <308>: DATABASE ACCESSION NUMBER: NCBI ACCESSION: NZ_LT906439.1
  ref <309>: DATABASE ENTRY DATE: 2019-04-01
  ref <313>: RELEVANT RESIDUES IN SEQ ID NO: (1)..(1563)
aatgagagtttgatcctggctcaggacgaacgctggcggcgtgcctaatacatgcaagtggaacgcttccttcttaccgagtgtttgcactcaccaagaaggaagagtcgcgaacgggtgagtaacgcgtaggtaacctgcctggtagcgggggataactattggaaacgatagctaataccgcataagagggtctaacacatgttaggagcttaaaagaagcaactgcttcactaccagatggacctgcgttgtattagctagttggtagggtaacggcctaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacggatatgagagtggaaagttcatatcgtgacggtaacttaccagaaagggacggctaactacgtgccagcagccgcggtaatacgtaggtcccgagcgttgtccggatttattgggcgtaaagcgagcgcaggcggttccgtaagtctgaagtaaaaggctgtggcttaaccatagtatgctttggaaactgcggaacttgagtgcagaaggggagagtggaattccatgtgtagcggtgaaatgcgtagatatatggaggaacaccggtggcgaaagcggctctctggtctgtaactgacgctgaggctcgaaagcgtgggtagcgaacaggattagataccctggtagtccacgccgtaaacgatgagtgctaggtgttgggtcctttccgggactcagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattggaggctgcaactcgcctccatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9110 - DNA, 1560 bp, Streptococcus milleri; identical to SEQ ID NO: 9079
  ref <308>: DATABASE ACCESSION NUMBER: NCBI ACCESSION: NZ_LR134307.1
  ref <309>: DATABASE ENTRY DATE: 2019-04-01
  ref <313>: RELEVANT RESIDUES IN SEQ ID NO: (1)..(1560)

SEQ ID NO: 9111 - DNA, 1563 bp, Streptococcus minor
  ref <308>: DATABASE ACCESSION NUMBER: NCBI ACCESSION: NZ_RQZA01000017.1
  ref <309>: DATABASE ENTRY DATE: 2019-04-01
  ref <313>: RELEVANT RESIDUES IN SEQ ID NO: (1)..(1563)
ttaatgagagtttgatcctggctcaggacgaacgctggcggcgtgcctaatacatgcaagtggaacgcattgatttcaccggagcttgctccaccgaaattagtgagtcgcgaacgggtgagtaacgcgtaggtaacctacctcttagcgggggataactattggaaacgatagctaataccgcataacaataggatacacatgtaccctatttaaaaggagcaactgcttcactaagagatggacctgcgttgtattagctagttggtagggtaacggcctaccaaggcatcgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgtgtgagagagtggaaagttctcacagtgacggtaacttaccagaaagggacggctaactacgtgccagcagccgcggtaatacgtaggtcccgagcgttgtccggatttattgggcgtaaagcgagcgcaggtggttgtataagtctgaagtaaaaggcagtggcttaaccattgtgtgctttggaaactgtacaacttgagtgcagaaggggagagtggaattccatgtgtagcggtgaaatgcgtagatatatggaggaacaccggtggcgaaagcggctctctggtctgtaactgacactgaggctcgaaagcgtggggagcaaacaggattagataccctggtagtccacgccgtaaacgatgagtgctaggtgttgggtcctttccgggactcagtgccgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccctctgaccgtcctagagataggattttccttcgggacagaggtgacaggtggtgcatggttgtcgtcagctcgtgtcgtgagatgttgggttaagtcccgcaacgagcgcaacccctattgttagttgccatcattgagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctctgaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9112 - DNA, 1553 bp, Streptococcus mitis
  ref <308>: DATABASE ACCESSION NUMBER: NCBI ACCESSION: NZ_UHFS01000003.1
  ref <309>: DATABASE ENTRY DATE: 2019-04-01
  ref <313>: RELEVANT RESIDUES IN SEQ ID NO: (1)..(1553)
ttaatgagagtttgatcctggctcaggacgaacgctggcggcgtgcctaatacatgcaagtagaacgctgaaggaggagcttgcttctccggatgagttgcgaacgggtgagtaacgcgtaggtaacctgcctggtagcgggggataactattggaaacgatagctaataccgcataagagtagatgttgcatgacatttgcttaaaaggtgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9113 - DNA, 1562 bp, Streptococcus mutans
  ref <308>: DATABASE ACCESSION NUMBER: NCBI ACCESSION: NZ_LR134491.1
  ref <309>: DATABASE ENTRY DATE: 2019-04-01
  ref <313>: RELEVANT RESIDUES IN SEQ ID NO: (1)..(1562)
aatgagagtttgatcctggctcaggacgaacgctggcggcgtgcctaatacatgcaagtggaacgcaagggaacacaccgtgcttgcacatcgtgttttcttgagtcgcgaacgggtgagtaacgcgtaggtaacctgcctattagcgggggataactattggaaacgatagctaataccgcataagagagtttaacacatgttagacgcttgaaagatgcaagagcatcactagtagatggacctgcgttgtattagctagtaggtagggtaaaggcctacctaggcgacgatacatagccgacctgagagggtgaccggccacactgggactgagacacggcccagactcctacgggaggcagcagtagggaatcttcggcaatggggggaaccctgaccgagcaacgccgcgtgagtgaagaaggttttcggatcgtaaagctctgttgtcagagacgaacgtgtgtgagagtggaaagttcacacagtgacggtaactgaccagaaagggacggctaactacgtgccagcagccgcggtaatacgtaggtcccgagcgttgtccggatttattgggcgtaaagcgagcgcaggcggttttgtaagtctgaagtcaaaggcagtggcttaaccattgtgtgctttggaaactgcaggacttgagtgcagaaggggagagtggaattccatgtgtagcggtgaaatgcgtagatatatggaggaacaccggtggcgaaagcggctctctggtctgtaactgacgctgaggctcgaaagcgtgggtagcgaacaggattagataccctggtagtccacgccgtaaacgctgagtgctaggtgttaggccctttccggggcttagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttttgtacatcggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggtcggtacaacgagtcgcgagccggtgacggcaagctaatctctgaaagccgatctcagttcggattggaggctgcaactcgcctccatgaagtcggaatcgctagtaatcgcggatcagcacgccgcggtgaatacgttcccgggccttgtacacaccgcccgtcacaccacgagagtttgtaacacccgaagtcggtgaggtaaccgttaaggagccagccgcctaaggtgggatggatgattggggtgaagtcgtaacaaggtagccgtatcggaaggtgcggctggatcacctcctttctaaggaa

SEQ ID NO: 9114 - DNA, 1555 bp, Streptococcus oralis
  ref <308>: DATABASE ACCESSION NUMBER: NCBI ACCESSION: NZ_LR134336.1
  ref <309>: DATABASE ENTRY DATE: 2019-04-01
  ref <313>: RELEVANT RESIDUES IN SEQ ID NO: (1)..(1555)
ttaatgagagtttgatcctggctcaggacgaacgctggcggcgtgcctaatacatgcaagtagaacgctgaagcttggtgcttgcaccgagcggatgagttgcgaacgggtgagtaacgcgtaggtaacctgcctggtagcgggggataactattggaaacgatagctaataccgcataagagtagatgttgcatgacatttacttaaaaggtgcaattgcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9115 - DNA, 1533 bp, Streptococcus orisasini
  ref <308>: DATABASE ACCESSION NUMBER: NCBI ACCESSION: NZ_BCLE01000060.1
  ref <309>: DATABASE ENTRY DATE: 2019-04-01
  ref <313>: RELEVANT RESIDUES IN SEQ ID NO: (1)..(1533)
ttaatgagagtttgatcctggctcaggacgaacgctggcggcgtgcctaatacatgcaagtggaacgcagtgaattcaccggagcttgctccaccgaattgactgagtcgcgaacgggtgagtaacgcgtaggtaaccaaccttatagcgggggacaactattggaaacgatagctaataccgcataacaatgacaaacacatgttagtgatttgaaaggggcaaatgctccactataagctggacctgcgttgtattagctagttggtagggtaaaggcctaccaaggctgcgatacatagccgacctgagagggtgaacggccacactgggactgagacacggcccagactcctacgggaggcagcagtagggaatcttcggcaatggggggaaccctgaccgagcaacgccgcgtgagtgaagaaggttttcggatcgtaaagctctgttgtcagagaagaacgggtgtgagagtggaaagttcacacagtgacggtacctgacgagaaagggacggctaactacgtgccagcagccgcggtaatacgtaggtcccgagcgttgtccggatttattgggcgtaaagcgagcgcaggcggctctgtaagtctgaagtaaaaggcagtggcttaaccattgtgtgctttggaaactgcggggcttgagtgcagaaggggagagtggaattccatgtgtagcggtgaaatgcgtagatatatggaggaacaccggtggcgaaagcggctctctggtctgagactgacgctgaggctcgaaagcgtgggtagcgaacaggattagataccctggtagtccacgccgtaaacgctgagtgctaggtgttaggccctttccggggcttagtgccgtagctaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatcccggtgccagtcctagagataggatttttcttcggaacactggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggtcggtacaacgagtcgcaagccggtgacggcaagctaatctctgaaagccgatctcagttcggattggaggctgcaactcgcctccatgaagtcggaatcgctagtaatcgcggatcagcacgccgcggtgaatacgttcccgggccttgtacacaccgcccgtcacaccacgagagtttgtaacacccgaagtcggtgaggtaacctattaggagccagccgcctaaggtgggatggatgattggggtgaagtcgtaacaaggtagccgtatcggaa

SEQ ID NO: 9116 - DNA, 1561 bp, Streptococcus orisratti
  ref <308>: DATABASE ACCESSION NUMBER: NCBI ACCESSION: NZ_KB904514.1
  ref <309>: DATABASE ENTRY DATE: 2019-04-01
  ref <313>: RELEVANT RESIDUES IN SEQ ID NO: (1)..(1561)
aatgagagtttgatcctggctcaggacgaacgctggcggcgtgcctaatacatgcaagtggaacgcatgattgataccggagcttgctccaccattaatcatgagtcgcgaacgggtgagtaacgcgtaggtaacctacctcatagcgggggataactattggaaacgatagctaataccgcataacagtcattaacacatgttagagacttgaaaggggcaagagcttcactatgagatggacctgcgttgtattagctagtaggtagggtaaaggcctacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttagagaagaacgtgtgtgagagtggaaagttcacacagtgacggtaactaaccagaaagggacggctaactacgtgccagcagccgcggtaatacgtaggtcccgagcgttgtccggatttattgggcgtaaagcgagcgcaggcggttctgtaagtctgaagttaaaggcagtggcttaaccattgtacgctttggaaactgcaggacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttttgtacatcggtgacaggtggtgcatggttgtcgtcagctcgtgtcgtgagatgttgggttaagtcccgcaacgagcgcaacccctattgttagttgccatcattgagttgggcactctagcgagactgccggtaataaaccggaggaaggtggggatgacgtcaaatcatcatgccccttatgacctgggctacacacgtgctacaatggctggtacaacgagttgcaagtcggtgacgacaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 9117 - DNA, 1563 bp, Streptococcus ovis
  ref <308>: DATABASE ACCESSION NUMBER: NCBI ACCESSION: NZ_KB904578.1
  ref <309>: DATABASE ENTRY DATE: 2019-04-01
  ref <313>: RELEVANT RESIDUES IN SEQ ID NO: (1)..(1563)
aatgagagtttgatcctggctcaggacgaacgctggcggcgtgcctaatacatgcaagtggaacgcagttaattcaccggagcttgctccaccgaattgactgagtcgcgaacgggtgagtaacgcgtaggtaacctgccttgtagcgggggataactattggaaacgatagctaataccgcataacaatatttgacacatgtcagatatttgaaaggagcaagtgctccactacgagatggacctgcgttgtattagctagtaggtagggtaacggcctacctaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaatgatagtaagagtggaaaatttactaagtgacggtatcttaccagaaagggacggctaactacgtgccagcagccgcggtaatacgtaggtcccgagcgttgtccggatttattgggcgtaaagcgagcgcaggcggttgtataagtcagaagtaaaaggcagtggctcaaccattgtgtgcttttgaaactgtacaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgatgcccgctctagagatagagttttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggtcggtacaacgagtcgcaagccggtgacggcaagctaatctcttaaagccgatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaacctttttaggagccagccgcctaaggtgggatagatgattggggtgaagtcgtaacaaggtagccgtatcggaaggtgcggctggatcacctcctttctaaggaa

SEQ ID NO: 9118 - DNA, 1562 bp, Streptococcus pantholopis
  ref <308>: DATABASE ACCESSION NUMBER: NCBI ACCESSION: NZ_CP014699.1
  ref <309>: DATABASE ENTRY DATE: 2019-04-01
  ref <313>: RELEVANT RESIDUES IN SEQ ID NO: (1)..(1562)
aatgagagtttgatcctggctcaggacgaacgctggcggcgtgcctaatacatgcaagtggaacgcacagtttgtcgattaacgtgttaatggacagattagtgagtcgcgaacgggtgagtaacgcgtaggtaacctttctctcagcgggggataactattggaaacgatagctaataccgcataagattttttaacgcctgttagaagattaaaaggagcactagcatcactgagaggtggacctgcgttgtattagctagttggtagggtagaggcctaccaaggcgatgatacatagccggcctgagagggtgaacggccacactgggactgagacacggcccagactcctacgggaggcagcagtagggaatcttcggcaatggggggaaccctgaccgagcaacgccgcgtgagtgaagaaggaattcgtttcgtaaagctctgttgtatgagaagaacgggtgtgagagtggaaagttcacactgtgacggtatcatacgaggaagggacggctaactacgtgccagcagccgcggtaatacgtaggtcccgagcgttgtccggatttattgggcgtaaagggagcgcaggcggtttcgtaagtcagaagtcaaaggcattggcttaaccaatgtatgcttttgaaactgcgggacttgagtacagaaggggagagtggaattccatgtgtagcggtgaaatgcgtagatatatggaggaacaccggcggcgaaagcggctctctggtctgttactgacgctgaggctcgaaagcgtggggagcaaacaggattagataccctggtagtccacgccgtaaacgctgagtgctaggtgttaggccctatccggggcttagtgccggagctaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatccctctgacaggactagagatagttttttctttcgggacagaggagacaggtggtgcatggttgtcgtcagctcgtgtcgtgagatgttgggttaagtcccgcaacgagcgcaacccttatggttagttaccatcattaagttggggactctagccagactgccggtaataaaccggaggaaggtggggatgacgtcaaatcatcatgccccttatgacctgggctacacacgtgctacaatggttggtacaacgagttgcgagtcggtgacggccagctaatctctgaaagccaatctcagttcggattggaggctgcaactcgcctccatgaagtcggaatcgctagtaatcgcggatcagcacgccgcggtgaatacgttcccgggccttgtacacaccgcccgtcacaccacgagagtttgtaacacccgaagtcggtgaggtaacctaatggagccagccgccgaaggtgggatagatgattggggtgaagtcgtaacaaggtagccgtatcggaaggtgcggctggatcacctcctttctaaggaa

SEQ ID NO: 9119 - DNA, 1555 bp, Streptococcus parasanguinis
  ref <308>: DATABASE ACCESSION NUMBER: NCBI ACCESSION: NZ_UHFZ01000003.1
  ref <309>: DATABASE ENTRY DATE: 2019-04-01
  ref <313>: RELEVANT RESIDUES IN SEQ ID NO: (1)..(1555)
ttaatgagagtttgatcctggctcaggatgaacgctggcggcgtgcctaatacatgcaagtagaacgctgaagcttggtgcttgcaccgagcggaggagttgcgaacgggtgagtaacgcgtaggtaacctgcctcttagcgggggataactattggaaacgatagctaataccgcataaaagtcgacattgcatgatgttgacttgaaaggtgcaaatgcatcactaagagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 9120 - DNA, 1554 bp, Streptococcus parauberis
  ref <308>: DATABASE ACCESSION NUMBER: NCBI ACCESSION: NZ_LHAE01000009.1
  ref <309>: DATABASE ENTRY DATE: 2019-04-01
  ref <313>: RELEVANT RESIDUES IN SEQ ID NO: (1)..(1554)
aatgagagtttgatcctggctcaggacgaacgctggcggcgtgcctaatacatgcaagtagaacgctgaagactggtgcttgcactagtcagatgagttgcgaacgggtgagtaacgcgtaggtaacctacctcatagcgggggataactattggaaacgatagctaataccgcatgacaattaagtactcatgtactaaatttaaaaggagcaattgcttcactatgagatggacctgcgttgtattagctagttggtgaggtaacggctcaccaaggctacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgttagagaagaacggtaatgggagtggaaaatccattacgtgacggtaactaaccagaaagggacggctaactacgtgccagcagccgcggtaatacgtaggtctcgagcgttgtccggatttattgggcgtaaagcgagcgcaggcggttatttaagtctgaagttaaaggccgtggctcaaccatggttcgctttggaaactggataacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgtcctagagataggactttccttcgggacagaggtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaacctattaggagccagccgcctaaggtgggatagatgattggggtgaagtcgtaacaaggtagccgtatcggaaggtgcggctggatcacctcctttctaaggaa

SEQ ID NO: 9121 - DNA, 1554 bp, Streptococcus pasteurianus
  ref <308>: DATABASE ACCESSION NUMBER: NCBI ACCESSION: NZ_LS483462.1
  ref <309>: DATABASE ENTRY DATE: 2019-04-01
  ref <313>: RELEVANT RESIDUES IN SEQ ID NO: (1)..(1554)
aatgagagtttgatcctggctcaggacgaacgctggcggcgtgcctaatacatgcaagtagaacgctgactactttagcttgctagagtagaaggagttgcgaacgggtgagtaacgcgtaggtaacctgcctactagcgggggataactattggaaacgatagctaataccgcataacagtgtttaacacatgttagatgcttgaaagatgcaattgcatcactagtagatggacctgcgttgtattagctagttggtggggtaacggcccaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgtgtgtgagagtggaaagttcacacagtgacggtaacttaccagaaagggacggctaactacgtgccagcagccgcggtaatacgtaggtcccgagcgttgtccggatttattgggcgtaaagcgagcgcaggcggtttaataagtctgaagttaaaggcagtggcttaaccattgttcgctttggaaactgttaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagtttcttcggaacatcggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggttggtacaacgagtcgcaagtcggtgacggcaagcaaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttaggagccagccgcctaaggtgggatagatgattggggtgaagtcgtaacaaggtagccgtatcggaaggtgcggctggatcacctcctttctaaggaa

SEQ ID NO: 9122 - DNA, 1554 bp, Streptococcus penaeicida
  ref <308>: DATABASE ACCESSION NUMBER: NCBI ACCESSION: NZ_LOCM01000081.1
  ref <309>: DATABASE ENTRY DATE: 2019-04-01
  ref <313>: RELEVANT RESIDUES IN SEQ ID NO: (1)..(1554)
aatgagagtttgatcctggctcaggacgaacgctggcggcgtgcctaatacatgcaagtagaacgctgaggtctagtgcttgcacaagaccaaggagttgcgaacgggtgagtaacgcgtaggtaacctacctcatagcgggggataactattggaaacgatagctaataccgcatgacaatagagtacacatgtacttaatttaaaaggggcaattgctccactatgagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttagagaagaacggtaatgggagtggaaaatccattacgtgacggtaactaaccagaaagggacggctaactacgtgccagcagccgcggtaatacgtaggtctcgagcgttgtccggatttattgggcgtaaagcgagcgcaggcggtttgataagtctgaagttaaaggctgtggcttaaccatagtatgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaycgtcctagagataggatttcccttykgggcagragtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9123 - DNA, 1552 bp, Streptococcus peroris
  ref <308>: DATABASE ACCESSION NUMBER: NCBI ACCESSION: NZ_GL732464.1
  ref <309>: DATABASE ENTRY DATE: 2019-04-01
  ref <313>: RELEVANT RESIDUES IN SEQ ID NO: (1)..(1552)
ttaatgagagtttgatcctggctcaggatgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataagagcagttgttgcatgacagctgtttaaaaggtgcaattgcaccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgagtgtgagagtggaaagttcacgctgtgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgccatttctagagataggaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctcctttctaagga

SEQ ID NO: 9124 - DNA, 1558 bp, Streptococcus phocae
  ref <308>: DATABASE ACCESSION NUMBER: NCBI ACCESSION: NZ_LHQM01000004.1
  ref <309>: DATABASE ENTRY DATE: 2019-04-01
  ref <313>: RELEVANT RESIDUES IN SEQ ID NO: (1)..(1558)
ttaatgagagtttgatcctggctcaggacgaacgctggcggcgtgcctaatacatgcaagtagaacgcctcttgcttagtgcttgcactaagtaagaggagttgcgaacgggtgagtaacgcgtaggtaacctaccttatagcgggggataactattggaaacgatagctaataccgcataagaagagttaacacatgttaattctttaaaaggggcaattgctccactatgagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgttagagaagaatgatggtgggagtggaaaatccaccatgtgacggtaactaaccagaaagggacggctaactacgtgccagcagccgcggtaatacgtaggtctcgagcgttgtccggatttattgggcgtaaagcgagcgcaggcggtttgataagtctgaagttaaaggccgtggctcaaccatggttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9125 - DNA, 1566 bp, Streptococcus pluranimalium
  ref <308>: DATABASE ACCESSION NUMBER: NCBI ACCESSION: NZ_CP022601.1
  ref <309>: DATABASE ENTRY DATE: 2019-04-01
  ref <313>: RELEVANT RESIDUES IN SEQ ID NO: (1)..(1566)
ttaatgagagtttgatcctggctcaggacgaacgctggcggcgtgcctaatacatgcaagtggaacgcaattgattctcccgtagcttgctacatttgaattgattgagtcgcgaacgggtgagtaacgcgtaggtaacctaccttatagcgggggataactattggaaacgatagctaataccgcataagagttgacaacacatgttgttaatttaaaaggagcaattgcttcactatgagatggacctgcgttgtattagctagttggtaaggtaacggcttaccaaggcctcgatacatagccgacctgagagggtgatcggccacactgggactgagacacggcccagactcctacgggaggcagcagtagggaatcttcggcaatggggggaaccctgaccgagcaacgccgcgtgagtgaagaaggttttaggatcgtaaagctctgttataagcgaagaacgggagtaagagtggaaagtttactctgtgacggtagcttatcagaaagggacggctaactacgtgccagcagccgcggtaatacgtaggtcccgagcgttgtccggatttattgggcgtaaagcgagcgcaggtggtttaataagtctgaagttaaaggcattggctcaaccaatgtacgctttggaaactgttaaacttgagtgcagaaggggagagtggaattccatgtgtagcggtgaaatgcgtagatatatggaggaacaccggtggcgaaagcggctctctggtctgtaactgacactgaggctcgaaagcgtgggtagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgtcctagagataggattttacttcggtacatcggtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggtcggtacaacgagcagcgaactggtgacagtaagccaatctcttaaagccgatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9126 - DNA, 1033 bp, Streptococcus plurextorum
  ref <308>: DATABASE ACCESSION NUMBER: NCBI ACCESSION: NZ_AUIO01000036.1
  ref <309>: DATABASE ENTRY DATE: 2019-04-01
  ref <313>: RELEVANT RESIDUES IN SEQ ID NO: (1)..(1033)
tgcttcactatgagatggacctgcgttgtattagctagttggtgaggtaacagctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaatgtgtgtgggagtggaaagtccacataatgacggtatcttaccagaaagggacggctaactacgtgccagcagccgcggtaatacgtaggtcccgagcgttgtccggatttattgggcgtaaagcgagcgcaggcggttatataagtctgaagtcaaaggcattggctcaaccaatgtacgctttggaaactgtagaacttgagtgcagaaggggagagtggaattccatgtgtagcggtgaaatgcgtagatatatggaggaacaccggtggcgaaagcggctctctggtctgtaactgacgctgaggctcgaaagcgtgggtagcgaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccagtgaccgtcctagagataggatttctcttcggagcactggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctgg

SEQ ID NO: 9127 - DNA, 1552 bp, Streptococcus pneumoniae
  ref <308>: DATABASE ACCESSION NUMBER: NCBI ACCESSION: NZ_LR134294.1
  ref <309>: DATABASE ENTRY DATE: 2019-04-01
  ref <313>: RELEVANT RESIDUES IN SEQ ID NO: (1)..(1552)
ttaatgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataagagtagatgttgcatgacatttgcttaaaaggtgcacttgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtaggctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgctgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaagga

SEQ ID NO: 9128 - DNA, 1459 bp, Streptococcus porci
  ref <308>: DATABASE ACCESSION NUMBER: NCBI ACCESSION: NZ_AUIP01000031.1
  ref <309>: DATABASE ENTRY DATE: 2019-04-01
  ref <313>: RELEVANT RESIDUES IN SEQ ID NO: (1)..(1459)
agttgcgaacgggtgagtaacgcgtaggtaacctggctcatagcgggggataactattggaaacgatagctaataccgcataagagtagctactgcatggtagctacttaaaaggagcaactgcttcactatgagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaatgtgtgtgggagtggaaagtccacataatgacggtatcttaccagaaagggacggctaactacgtgccagcagccgcggtaatacgtaggtcccgagcgttgtccggatttattgggcgtaaagcgagcgcaggcggttttgtaagtctgaagtcaaaggcattggctcaaccaatgtacgctttggaaactgcgagacttgagtgcagaaggggagagtggaattccatgtgtagcggtgaaatgcgtagatatatggaggaacaccggtggcgaaagcggctctctggtctgtaactgacgctgaggctcgaaagcgtgggtagcgaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccagtgaccgccctagagatagggtttctcttcggagcactggtgacaggtggtgcatggttgtcgtcagctcgtgtcgtgagatgttgggttaagtcccgcaacgagcgcaacccctattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagccggtgacggcaagcaaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaacctattaggagccagccgcctaaggtgggatagatgattggggtgaagtcgtaacaaggtagccgtatcggaaggtgcggctggatcacctcctttctaaggaa

SEQ ID NO: 9129 - DNA, 1554 bp, Streptococcus porcinus
  ref <308>: DATABASE ACCESSION NUMBER: NCBI ACCESSION: NZ_LS483388.1
  ref <309>: DATABASE ENTRY DATE: 2019-04-01
  ref <313>: RELEVANT RESIDUES IN SEQ ID NO: (1)..(1554)
aatgagagtttgatcctggctcaggacgaacgctggcggcgtgcctaatacatgcaagtagaacgcagaggacaggtgcttgcaccagtctaatgagttgcgaacgggtgagtaacgcgtaggtaacctaccttatagcgggggataactattggaaacgatagctaataccgcatgaaagtagaagacccatgtcatctacttaaaaggggcaactgctccactatgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttagagaagaacggtaatgggagtggaaaatccattacgtgacggtaactaaccagaaagggacggctaactacgtgccagcagccgcggtaatacgtaggtcccgagcgttgtccggatttattgggcgtaaagcgagcgcaggcggtttgataagtctgaagttaaaggctgtggcttaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttaggagccagccgcctaaggtgggatagatgattggggtgaagtcgtaacaaggtagccgtatcggaaggtgcggctggatcacctcctttctaaggaa

SEQ ID NO: 9130 - DNA, 1553 bp, Streptococcus pseudopneumoniae
  ref <308>: DATABASE ACCESSION NUMBER: NCBI ACCESSION: NZ_RAHZ01000032.1
  ref <309>: DATABASE ENTRY DATE: 2019-04-01
  ref <313>: RELEVANT RESIDUES IN SEQ ID NO: (1)..(1553)
ttaatgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataagagtagatgttgcatgacatttgcttaaaaggtgcaaatgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtaggctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9131 - DNA, 1554 bp, Streptococcus pseudoporcinus
  ref <308>: DATABASE ACCESSION NUMBER: NCBI ACCESSION: NZ_LR134341.1
  ref <309>: DATABASE ENTRY DATE: 2019-04-01
  ref <313>: RELEVANT RESIDUES IN SEQ ID NO: (1)..(1554)
aaagagagtttgatcctggctcaggacgaacgctggcggcgtgcctaatacatgcaagtagaacgctgaggtctggtgcttgcactagaccaaggagttgcgaacgggtgagtaacgcgtaggtaacctacctcatagcgggggataactattggaaacgatagctaataccgcatgagactggggttcacatgaacccgagttaaaaggagcaaaagcttcactatgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttagagaagaacggtaatgggagtggaaaatccattatgtgacggtaactaaccagaaagggacggctaactacgtgccagcagccgcggtaatacgtaggtcccgagcgttgtccggatttattgggcgtaaagcgagcgcaggcggtttgataagtctgaagttaaaggctgtggcttaaccatagtatgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttaggagcagaagagacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9132 - DNA, 1556 bp, Streptococcus pyogenes
  ref <308>: DATABASE ACCESSION NUMBER: NCBI ACCESSION: NZ_LR134314.1
  ref <309>: DATABASE ENTRY DATE: 2019-04-01
  ref <313>: RELEVANT RESIDUES IN SEQ ID NO: (1)..(1556)
ttaaagagagtttgatcctggctcaggacgaacgctggcggcgtgcctaatacatgcaagtagaacgctgagaactggtgcttgcaccggttcaaggagttgcgaacgggtgagtaacgcgtaggtaacctacctcatagcgggggataactattggaaacgatagctaataccgcataagagagactaacgcatgttagtaatttaaaaggggcaattgctccactatgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgttagagaagaatgatggtgggagtggaaaatccaccaagtgacggtaactaaccagaaagggacggctaactacgtgccagcagccgcggtaatacgtaggtcccgagcgttgtccggatttattgggcgtaaagcgagcgcaggcggttttttaagtctgaagttaaaggcattggctcaaccaatgtacgctttggaaactggagaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagtcggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaacctattaggagccagccgcctaaggtgggatagatgattggggtgaagtcgtaacaaggtagccgtatcggaaggtgcggctggatcacctcctttctaaggaa

SEQ ID NO: 9133 - DNA, 765 bp, Streptococcus ratti
  ref <308>: DATABASE ACCESSION NUMBER: NCBI ACCESSION: NZ_AOCD01000014.1
  ref <309>: DATABASE ENTRY DATE: 2019-04-01
  ref <313>: RELEVANT RESIDUES IN SEQ ID NO: (1)..(765)
taaatgagagtttgatcctggctcaggacgaacgctggcggcgtgcctaatacatgcaagtggagcgcaagggaacacaccgtgcttgtacatcgtgttttcttgagtcgcgtacgggtgagtaacgcgtaggtaacatgcctattagcgggggataactatttgaaacgatagctaataccgcataagagagtttaacacatgttagacgcttgaaagatgctagagcatcactagtagatagacctgcgttgtattagatagtaggtagggtaaagccctacatcggcgacgacacatagccgacctgagagggtgaccggccacactgggactgagacacggcccagactcctacgggaggcagcagtagggaatctccggcaatggggggaaccctgacagagcaacgccgggtgagtgaagaaggtttgcggatcgtaaagctctgttgtaagagacgaacgggtgtgagagtggaaagctcacacagtgacggtcactgaccagaaagggacgcctaactacgtgccagcagacgcggtaatacgtaggtcccgagcgttgtccggatttattgggcgtaaagcgagcgcaggcggttttgtaagtctgaagtcaaaggcagtggcttaaccattgtgtgctttggaaactgcaggacttgattgcagaaggggagagtggacttccctgtgtagcggtgaaatgggtagatatatggaggaactccgctggcgaaagcggctctccggtctgtaactg

SEQ ID NO: 9134 - DNA, 1554 bp, Streptococcus respiraculi
  ref <308>: DATABASE ACCESSION NUMBER: NCBI ACCESSION: NZ_CP022680.1
  ref <309>: DATABASE ENTRY DATE: 2019-04-01
  ref <313>: RELEVANT RESIDUES IN SEQ ID NO: (1)..(1554)
aatgagagtttgatcctggctcaggacgaacgctggcggcgtgcctaatacatgcaagtagaacgctgaagcttggtgcttgcaccgagcggaggagttgcgaacgggtgagtaacgcgtaggtaacctgcctggtagcgggggataactattggaaacgatagctaataccgcataaaagtacttactgcatggtaagtatttgaaaggtgcaattgcaccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgttagcgggagtggaaaatccgctaagtgacggtaacttaccagaaagggacggctaactacgtgccagcagccgcggtaatacgtaggtcccgagcgttgtccggatttattgggcgtaaagcgagcgcaggcggtttgataagtcagaagtaaaaggctgtggctcaaccatagtacgcttttgaaactgtcaaacttgagtgcagaaggggggagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccagtgaccgtcctagagataggatttttcttcggaacactggtgacaggtggtgcatggttgtcgtcagctcgtgtcgtgagatgttgggttaagtcccgcaacgagcgcaacccctattgttagttgccatcattgagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9135 - DNA, 1562 bp, Streptococcus ruminantium
  ref <308>: DATABASE ACCESSION NUMBER: NCBI ACCESSION: NZ_AP018400.1
  ref <309>: DATABASE ENTRY DATE: 2019-04-01
  ref <313>: RELEVANT RESIDUES IN SEQ ID NO: (1)..(1562)
atgagagtttgatcctggctcaggacgaacgctggcggcgtgcctaatacatgcaagtggaacgcaacttttcatccgtttcttcggaaacatctgagaagttgagtcgcgaacgggtgagtaacgcgtaggtaacctgcctgatagcgggggataactattggaaacgatagctaataccgcataagagctttagtggcatcattggagcttaaaaggagcaactgcttcactatcagatggacctgcgttgtattagctagttggtggggtaaaggcctaccaaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgtgtgagagagtggaaagttctcacagtgacggtatcttaccagaaagggacggctaactacgtgccagcagccgcggtaatacgtaggtcccgagcgttgtccggatttattgggcgtaaagcgagcgcaggcggtttcgtaagtctgaagtaaaaggctgtggcttaaccatagtacgctttggaaactgcggaacttgagtgcagaaggggagagtggaattccatgtgtagcggtgaaatgcgtagatatatggaggaacaccggtggcgaaagcggctctctggtctgtaactgacgctgaggctcgaaagcgtgggtagcgaacaggattagataccctggtagtccacgccgtaaacgatgagtgctaggtgttgggtcctttccgggactcagtgccgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccagtgaccgccctagagatagggtttctcttcggagcactggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgttaaggagccagccgcctaaggtgggatagatgattggggtgaagtcgtaacaaggtagccgtatcggaaggtgcggctggatcacctcctttctaagga

SEQ ID NO: 9136 - DNA, 1555 bp, Streptococcus salivarius
  ref <308>: DATABASE ACCESSION NUMBER: NCBI ACCESSION: NZ_LR134274.1
  ref <309>: DATABASE ENTRY DATE: 2019-04-01
  ref <313>: RELEVANT RESIDUES IN SEQ ID NO: (1)..(1555)
ttaatgagagtttgatcctggctcaggacgaacgctggcggcgtgcctaatacatgcaagtagaacgctgaagagaggagcttgctcttcttggatgagttgcgaacgggtgagtaacgcgtaggtaacctgccttgtagcgggggataactattggaaacgatagctaataccgcataacaatggatgacacatgtcatttatttgaaaggggcaattgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 9137 - DNA, 1554 bp, Streptococcus sanguinis
  ref <308>: DATABASE ACCESSION NUMBER: NCBI ACCESSION: NZ_LR134002.1
  ref <309>: DATABASE ENTRY DATE: 2019-04-01
  ref <313>: RELEVANT RESIDUES IN SEQ ID NO: (1)..(1554)
ttaatgagagtttgatcctggctcaggacgaacgctggcggcgtgcctaatacatgcaagtagaacgctgaagagaggagcttgctcttcttggatgagttgcgaacgggtgagtaacgcgtaggtaacctgcctggtagcgggggataactattggaaacgatagctaataccgcatgaaattgaatatcgcatgatacttaattgaaagatgcaactgcatcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgggtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtatgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccactctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaagga

SEQ ID NO: 9138 - DNA, 1564 bp, Streptococcus sinensis
  ref <308>: DATABASE ACCESSION NUMBER: NCBI ACCESSION: NZ_JPEN01000064.1
  ref <309>: DATABASE ENTRY DATE: 2019-04-01
  ref <313>: RELEVANT RESIDUES IN SEQ ID NO: (1)..(1564)
ttaatgagagtttgatcctggctcaggacgaacgctggcggcgtgcctaatacatgcaagtggaacgcacaaggtgcaccgtagtttactacaccgtactttgtgagtcgcgaacgggtgagtaacgcgtaggtaacctaccttttagcgggggataactattggaaacgatagctaataccgcataagatatcttactgcatggtaagatattaaaagatgcaattgcatcactaagagatggacctgcgttgtattagctagtaggtgaggtaacggctcacctaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccggtgcccgtcctagagataggattttgcttcggcacaccggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9139 - DNA, 1564 bp, Streptococcus sobrinus
  ref <308>: DATABASE ACCESSION NUMBER: NCBI ACCESSION: NZ_LS483378.1
  ref <309>: DATABASE ENTRY DATE: 2019-04-01
  ref <313>: RELEVANT RESIDUES IN SEQ ID NO: (1)..(1564)
ttaaacgagagtttgatcctggctcaggacgaacgctggcggcgtgcctaatacatgcaagtggaacgcattggtaacaccggacttgctccagtgttactaatgagtcgcgaacgggtgagtaacgcgtaggtaacctgcctgatagcgggggataactattggaaacgatagctaataccgcataagaggagttaactcatgttaactgtttaaaagaagccattgcttcactatcagatggacctgcgttgtattagctagtaggtagggtaacggcctacctaggcaacgatacatagccgacctgagagggtgaacggccacactgggactgagacacggcccagactcctacgggaggcagcagtagggaatcttcggcaatggacgcaagtctgaccgagcaacgccgcgtgagtgaagacggttttcggatcgtaaagctctgttgtaggggaagaacgtgtgtaagagtggaaagcttacacagtgacggtaccctaccagaaagggacggctaactacgtgccagcagccgcggtaatacgtaggtcccgagcgttgtccggatttattgggcgtaaagggagcgcaggcggtttagtaagtctgaagttaaaggcattggctcaaccaatgtatgctttggaaactgttagacttgagtgcagaaggggagagtggaattccatgtgtagcggtgaaatgcgtagatatatggaggaacaccggtggcgaaagcggctctctggtctgtcactgacgctgaggctcgaaagcgtgggtagcgaacaggattagataccctggtagtccacgccgtaaacgctgagtgctaggtgttaggtcctttccgggacttagtgccgacgctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagtttttcttcggaacatcggagacaggtggtgcatggttgtcgtcagctcgtgtcgtgagatgttgggttaagtcccgcaacgagcgcaacccttattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctctgaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccaaagtcggtgaggtaaccatttatggggccagccgcctaaggtgggatggatgattggggtgaagtcgtaacaaggtagccgtatcggaaggtgcggctggatcacctcctttctaagga

SEQ ID NO: 9140 - DNA, 1555 bp, Streptococcus sp. 1004 SSPC
  ref <308>: DATABASE ACCESSION NUMBER: NCBI ACCESSION: NZ_JWGQ01000122.1
  ref <309>: DATABASE ENTRY DATE: 2019-04-01
  ref <313>: RELEVANT RESIDUES IN SEQ ID NO: (1)..(1555)
ttaatgagagtttgatcctggctcaggacgaacgctggcggcgtgcctaatacatgcaagtagaacgctgaagagaggagcttgctcttcttggatgagttgcgaacgggtgagtaacgcgtaggtaacctgccttgtagcgggggataactattggaaacgatagctaataccgcataacaataggtgacacatgtcatttatttgaaaggggcaattgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 9141 - DNA, 1555 bp, Streptococcus sp. 1171 SSPC
  ref <308>: DATABASE ACCESSION NUMBER: NCBI ACCESSION: NZ_JWAK01000023.1
  ref <309>: DATABASE ENTRY DATE: 2019-04-01
  ref <313>: RELEVANT RESIDUES IN SEQ ID NO: (1)..(1555)
ttaatgagagtttgatcctggctcaggatgaacgctggcggcgtgcctaatacatgcaagtagaacgctgaaggaaggagcttgctctttccggatgagttgcgaacgggtgagtaacgcgtaggtaacctgcctggtagcgggggataactattggaaacgatagctaataccgcataacagtagatgttgcatgatatctgcttgaaaggtgcaattgcatcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9142 - DNA, 1538 bp, Streptococcus sp. 263 SSPC
  ref <308>: DATABASE ACCESSION NUMBER: NCBI ACCESSION: NZ_JVNU01000049.1
  ref <309>: DATABASE ENTRY DATE: 2019-04-01
  ref <313>: RELEVANT RESIDUES IN SEQ ID NO: (1)..(1538)
tttcatgagagtttgatcctggctcaggacgaacgctggcggcgtgcctaatacatgcaagtcgaacgagagcgaccggtgcttgcactggtcaatctagtggcgaacgggtgagtaacacgtgggtaacctgcccatcagagggggataacattcggaaacggatgctaaaaccgcataggtcttcgaaccgcatggtttgaagaggaaaagaggcgcaagcttctgctgatggatggacccgcggtgcattagctagttggtgaggtaacggctcaccaaggccgtgatgcatagccgacctgagagggtgatcggccacattgggactgagacacggcccaaactcctacgggaggcagcagtagggaatcttccgcaatggacgcaagtctgacggagcaacgccgcgtgagtgaagaaggttttcggatcgtaaaactctgttgttagagaagaacaagtgctagagtaactgttagcgccttgacggtatctaaccagaaagccacggctaactacgtgccagcagccgcggtaatacgtaggtggcaagcgttgtccggatttattgggcgtaaagcgagcgcaggcggttccttaagtctgatgtgaaagcccccggctcaaccggggagggtcattggaaactggggaacttgagtgcagaagaggagagtggaattccatgtgtagcggtgaaatgcgtagatatatggaggaacaccagtggcgaaggcgactctctggtctgtaactgacgctgaggctcgaaagcgtgggtagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcattgagttgggcactctagtgagactgccggtgacaaaccggaggaaggtggggatgacgtcaaatcatcatgccccttatgacttgggctacacacgtgctacaatggatggtacaacgagcagcgaactcgcgagggtaagcgaatctcttaaagccattctcagttcggattgtaggctgcaactcgcctacatgaagccggaatcgctagtaatcgcggatcagcacgccgcggtgaatacgttcccgggtcttgtacacaccgcccgtcacaccacgagagtttgtaacacccaaagtcggtgaggtaaccttttggagccagccgcctaaggtgggatagatgattggggtgaagtcgtaacaaggtagccgtatcggaaggtgcggctgg

SEQ ID NO: 9143 - DNA, 1556 bp, Streptococcus sp. 28462
  ref <308>: DATABASE ACCESSION NUMBER: NCBI ACCESSION: NZ_RCVM01000037.1
  ref <309>: DATABASE ENTRY DATE: 2019-04-01
  ref <313>: RELEVANT RESIDUES IN SEQ ID NO: (1)..(1556)
ttaatgagagtttgatcctggctcaggacgaacgctggcggcgtgcctaatacatgcaagtagaacgctgaagtctggtgcttgcactagacggatgagttgcgaacgggtgagtaacgcgtaggtaacctaccttatagcgggggataactattggaaacgatagctaataccgcataacaggtgttaacacatgttaatatcttgaaagggacaactgtctcactataagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgggtgttagagtggaaagttaacactatgacggtatcttaccagaaagggacggctaactacgtgccagcagccgcggtaatacgtaggtcccgagcgttgtccggatttattgggcgtaaagcgagcgcaggcggtttcgtaagtctgaggtcaaaggcattggctcaaccaatgtacgccttggaaactgcggaacttgagtgcagaaggggagagtggaattccatgtgtagcggtgaaatgcgtagatatatggaggaacaccggtggcgaaagcggctctctggtctgtaactgacgctgaggctcgaaagcgtgggtagcgaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgtcctagagataggacttctcttcggagcagaggtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtggcaagctggtgacagtaagcaaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9144 - DNA, 1562 bp, Streptococcus sp. 2 1 36FAA
  ref <308>: DATABASE ACCESSION NUMBER: NCBI ACCESSION: NZ_KI391975.1
  ref <309>: DATABASE ENTRY DATE: 2019-04-01
  ref <313>: RELEVANT RESIDUES IN SEQ ID NO: (1)..(1562)
aatgagagtttgatcctggctcaggacgaacgctggcggcgtgcctaatacatgcaagtagaacgcacagtttataccgtagcttgctacaccatagactgtgagttgcgaacgggtgagtaacgcgtaggtaacctgcctggtagcgggggataactattggaaacgatagctaataccgcataatattaattattgcatgataattgattgaaaggtgcaaatgcatcactaccagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtaagagaagaacgggtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9145 - DNA, 1555 bp, Streptococcus sp. 343 SSPC
  ref <308>: DATABASE ACCESSION NUMBER: NCBI ACCESSION: NZ_JVKU01000004.1
  ref <309>: DATABASE ENTRY DATE: 2019-04-01
  ref <313>: RELEVANT RESIDUES IN SEQ ID NO: (1)..(1555)
ttaatgagagtttgatcctggctcaggatgaacgctggcggcgtgcctaatacatgcaagtagaacgctgaaggaaggagcttgctctttccggatgagttgcgaacgggtgagtaacgcgtaggtaacctgcctggtagcgggggataactattggaaacgatagctaataccgcataacagtagatattgcatgatatctgcttgaaaggggcaattgctccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9146 - DNA, 1554 bp, Streptococcus sp. 400 SSPC
  ref <308>: DATABASE ACCESSION NUMBER: NCBI ACCESSION: NZ_JVIQ01000075.1
  ref <309>: DATABASE ENTRY DATE: 2019-04-01
  ref <313>: RELEVANT RESIDUES IN SEQ ID NO: (1)..(1554)
ttaatgagagtttgatcctggctcaggatgaacgctggcggcgtgcctaatacatgcaagtagaacgctgaagswwggwgcttgcwcykwsyggatgagttgcgaacgggtgagtaacgcgtaggtaacctgcctggtagcgggggataactattggaaacgatagctaataccgcataacagtagatgttgcatgacaactatttgaaaggggcaattgctccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgatcgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctcctttctaagga

SEQ ID NO: 9147 - DNA, 1555 bp, Streptococcus sp. 449 SSPC; identical to SEQ ID NO: 9136
  ref <308>: DATABASE ACCESSION NUMBER: NCBI ACCESSION: NZ_JVGR01000005.1
  ref <309>: DATABASE ENTRY DATE: 2019-04-01
  ref <313>: RELEVANT RESIDUES IN SEQ ID NO: (1)..(1555)

SEQ ID NO: 9148 - DNA, 1553 bp, Streptococcus sp. 45
  ref <308>: DATABASE ACCESSION NUMBER: NCBI ACCESSION: NZ_FNXZ01000010.1
  ref <309>: DATABASE ENTRY DATE: 2019-04-01
  ref <313>: RELEVANT RESIDUES IN SEQ ID NO: (1)..(1553)
aatgagagtttgatcctggctcaggacgaacgctggcggcgtgcctaatacatgcaagtagaacgctgaagactttagcttgctaaagttggaagagttgcgaacgggtgagtaacgcgtaggtaacctgcctactagcgggggataactattggaaacgatagctaataccgcataacagcatttaacccatgttagatgcttgaaaggagcaattgcttcactagtagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgtgtgtgagagtggaaagttcacacagtgacggtaacttaccagaaagggacggctaactacgtgccagcagccgcggtaatacgtaggtcccgagcgttgtccggatttattgggcgtaaagcgagcgcaggcggtttaataagtctgaagttaaaggcagtggcttaaccattgttcgctttggaaactgttagacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctattcctagagataggaagtttcttcggaacatcggtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcgagtcggtgacggcaagcaaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9149 - DNA, 1552 bp, Streptococcus sp. 596553
  ref <308>: DATABASE ACCESSION NUMBER: NCBI ACCESSION: NZ_OXCQ01000023.1
  ref <309>: DATABASE ENTRY DATE: 2019-04-01
  ref <313>: RELEVANT RESIDUES IN SEQ ID NO: (1)..(1552)
ttaatgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataagagtagatgttgtatgacatttacttaaaaggtgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtgagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaagga

SEQ ID NO: 9150 - DNA, 1348 bp, Streptococcus sp. A12
  misc_feature (822)..(822): n is a, c, g, or t
  ref <308>: DATABASE ACCESSION NUMBER: NCBI ACCESSION: NZ_RJQA01000009.1
  ref <309>: DATABASE ENTRY DATE: 2019-04-01
  ref <313>: RELEVANT RESIDUES IN SEQ ID NO: (1)..(1348)
aatgaaaaaacaataacactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagntttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9151 - DNA, 1560 bp, Streptococcus sp. AC15
  ref <308>: DATABASE ACCESSION NUMBER: NCBI ACCESSION: NZ_JDFJ01000029.1
  ref <309>: DATABASE ENTRY DATE: 2019-04-01
  ref <313>: RELEVANT RESIDUES IN SEQ ID NO: (1)..(1560)
atgagagtttgatcctggctcaggacgaacgctggcggcgtgcctaatacatgcaagtaggacgcacagtttataccgtagcttgctacaccatagactgtgagttgcgaacgggtgagtaacgcgtaggtaacctgcctattagagggggataactattggaaacgatagctaataccgcataacagtatgtaacacatgttagatgcttgaaagatgcaattgcatcgctagtagatggacctgcgttgtattagctagtaggtagggtaatggcctacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgagtgtgaaaatggaaagttcatactgtgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagataggaagtttcttcggaacatcggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9152 - DNA, 1560 bp, Streptococcus sp. ACC21; identical to SEQ ID NO: 9151
  ref <308>: DATABASE ACCESSION NUMBER: NCBI ACCESSION: NZ_JAQU01000015.1
  ref <309>: DATABASE ENTRY DATE: 2019-04-01
  ref <313>: RELEVANT RESIDUES IN SEQ ID NO: (1)..(1560)

SEQ ID NO: 9153 - DNA, 1555 bp, Streptococcus sp. ACS2; identical to SEQ ID NO: 9136
  ref <308>: DATABASE ACCESSION NUMBER: NCBI ACCESSION: NZ_JALT01000037.1
  ref <309>: DATABASE ENTRY DATE: 2019-04-01
  ref <313>: RELEVANT RESIDUES IN SEQ ID NO: (1)..(1555)

SEQ ID NO: 9154 - DNA, 1165 bp, Streptococcus sp. AM28-20
  ref <308>: DATABASE ACCESSION NUMBER: NCBI ACCESSION: NZ_QTNK01000005.1
  ref <309>: DATABASE ENTRY DATE: 2019-04-01
  ref <313>: RELEVANT RESIDUES IN SEQ ID NO: (1)..(1165)
ctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9155 - DNA, 1555 bp, Streptococcus sp. AM43-2AT
  ref <308>: DATABASE ACCESSION NUMBER: NCBI ACCESSION: NZ_QTND01000003.1
  ref <309>: DATABASE ENTRY DATE: 2019-04-01
  ref <313>: RELEVANT RESIDUES IN SEQ ID NO: (1)..(1555)
ttaatgagagtttgatccttgctcaggatgaacgctggcggcgtgcctaatacatgcaagtagaacgctgaagcttggtgcttgcaccgagcggatgagttgcgaacgggtaagtaacgcgtaggtaacctgcctggtagcgggggataactattggaaacgatagctaataccgcataacaacagttgttgcatgacagctgtttgaaaggggcaattgctccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9156 - DNA, 357 bp, Streptococcus sp. AS14
  ref <308>: DATABASE ACCESSION NUMBER: NCBI ACCESSION: NZ_ALKI01000016.1
  ref <309>: DATABASE ENTRY DATE: 2019-04-01
  ref <313>: RELEVANT RESIDUES IN SEQ ID NO: (1)..(357)
ttttaatgagagtttgatcctggctcaggacgaacgctggcggcgtgcctaatacatgcaagtagaacgctgaagagaggagcttgctcttcttggatgagttgcgaacgggtgagtaacgcgtaggtaacctgcctggtagcgggggataactattggaaacgatagctaataccgcataacaacagttgttgcatgacagctgtttaaaagatgcaattgcatcactaccagatggacctgcgttgtattagctagttggtgaggtaacggctcaccaaggcgacgatacatagccgacctgagagggtgatcggccacactgggactgagacacggcccagacgcctacgggag

SEQ ID NO: 9157 - DNA, 1560 bp, Streptococcus sp. AS20
  ref <308>: DATABASE ACCESSION NUMBER: NCBI ACCESSION: NZ_JANS01000016.1
  ref <309>: DATABASE ENTRY DATE: 2019-04-01
  ref <313>: RELEVANT RESIDUES IN SEQ ID NO: (1)..(1560)
atgagagtttgatcctggctcaggacgaacgctggcggcgtgcctaatacatgcaagtagaacgcacaggatgcaccgtagtttactacaccgtattctgtgagttgcgaacgggtgagtaacgcgtaggtaacctgcctggtagcgggggataactattggaaacgatagctaataccgcataagaacatttactgcatggtagatgtttaaaaggtgcaagagcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgtgtgtgagagtggaaagttcacacagtgacggtacttaaccagaaagggacggctaactacgtgccagcagccgcggtaatacgtaggtcccgagcgttgtccggatttattgggcgtaaagcgagcgcaggcggttagataagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagctttacttcggtacatcggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9158 - DNA, 1363 bp, Streptococcus sp. BCA20
  ref <308>: DATABASE ACCESSION NUMBER: NCBI ACCESSION: NZ_RJMD01000023.1
  ref <309>: DATABASE ENTRY DATE: 2019-04-01
  ref <313>: RELEVANT RESIDUES IN SEQ ID NO: (1)..(1363)
ttaatgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataatagtagatgttgcatgacatttgcttaaaaggtgcaattgcatcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9159 - DNA, 1555 bp, Streptococcus sp. BS21
  ref <308>: DATABASE ACCESSION NUMBER: NCBI ACCESSION: NZ_JANT01000007.1
  ref <309>: DATABASE ENTRY DATE: 2019-04-01
  ref <313>: RELEVANT RESIDUES IN SEQ ID NO: (1)..(1555)
ttaatgagagtttgatcctggctcaggacgaacgctggcggcgtgcctaatacatgcaagtagaacgctgaagagaggagcttgctcttcttggatgagttgcgaacgggtgagtaacgcgtaggtaacctgcctggtagcgggggataactattggaaacgatagctaataccgcataaaatggattatcgcatgataattcattgaaaggtgcaaatgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9160 - DNA, 1555 bp, Streptococcus sp. BS29a; identical to SEQ ID NO: 9159
  ref <308>: DATABASE ACCESSION NUMBER: NCBI ACCESSION: NZ_AZYV01000012.1
  ref <309>: DATABASE ENTRY DATE: 2019-04-01
  ref <313>: RELEVANT RESIDUES IN SEQ ID NO: (1)..(1555)

SEQ ID NO: 9161 - DNA, 1555 bp, Streptococcus sp. C150
  ref <308>: DATABASE ACCESSION NUMBER: NCBI ACCESSION: NZ_GL698454.1
  ref <309>: DATABASE ENTRY DATE: 2019-04-01
  ref <313>: RELEVANT RESIDUES IN SEQ ID NO: (1)..(1555)
ttaatgagagtttgatcctggctcaggacgaacgctggcggcgtgcctaatacatgcaagtagaacgctgaagagaggagcttgctcttcttggaagagttgcgaacgggtgagtaacgcgtaggtaacctgccttgtagcgggggataactattggaaacgatagctaataccgcataacaatgggtgacccatgtcattcatttgaaaggggcaactgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagataggaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcgagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttatggagccagccgcctaaggtgggatagatgattggggtgaagtcgtaacaaggtagccgtatcggaaggtgcggctggatcacctcctttctaaggaa

SEQ ID NO: 9162 - DNA, 1553 bp, Streptococcus sp. C300
  ref <308>: DATABASE ACCESSION NUMBER: NCBI ACCESSION: NZ_GL732470.1
  ref <309>: DATABASE ENTRY DATE: 2019-04-01
  ref <313>: RELEVANT RESIDUES IN SEQ ID NO: (1)..(1553)
ttaatgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataatagtagatgttgcatgacatttgcttaaaaggtgcaattgcatcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9163 - DNA, 1555 bp, Streptococcus sp. CCH5-D3; identical to SEQ ID NO: 9136
  ref <308>: DATABASE ACCESSION NUMBER: NCBI ACCESSION: NZ_LSIW01000129.1
  ref <309>: DATABASE ENTRY DATE: 2019-04-01
  ref <313>: RELEVANT RESIDUES IN SEQ ID NO: (1)..(1555)

SEQ ID NO: 9164 - DNA, 1555 bp, Streptococcus sp. CCH8-H5; identical to SEQ ID NO: 9136
  ref <308>: DATABASE ACCESSION NUMBER: NCBI ACCESSION: NZ_LSIZ01000135.1
  ref <309>: DATABASE ENTRY DATE: 2019-04-01
  ref <313>: RELEVANT RESIDUES IN SEQ ID NO: (1)..(1555)

SEQ ID NO: 9165 - DNA, 1552 bp, Streptococcus sp. CCUG 49591
  ref <308>: DATABASE ACCESSION NUMBER: NCBI ACCESSION: NZ_LVJM01000002.1
  ref <309>: DATABASE ENTRY DATE: 2019-04-01
  ref <313>: RELEVANT RESIDUES IN SEQ ID NO: (1)..(1552)
ttaatgagagtttgatcctggctcaggacgaacgctggcggcgtgcctaatacatgcaagtagaacgctgaaggaggagcttgcttctccggatgagttgcgaacgggtgagtaacgcgtaggtaacctgcctggtagcgggggataactattggaaacgatagctaataccgcataagagtagatgttgcatgacatttgcttaaaaggtgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaagga

SEQ ID NO: 9166 - DNA, 1555 bp, Streptococcus sp. CM6
  ref <308>: DATABASE ACCESSION NUMBER: NCBI ACCESSION: NZ_JATS01000010.1
  ref <309>: DATABASE ENTRY DATE: 2019-04-01
  ref <313>: RELEVANT RESIDUES IN SEQ ID NO: (1)..(1555)
ttaatgagagtttgatcctggctcaggacgaacgctggcggcgtgcctaatacatgcaagtagaacgctgaagagaggagcttgctcttcttggatgagttgcgaacgggtgagtaacgcgtaggtaacctgcctggtagcgggggataactattggaaacgatagctaataccgcataaaatggattatcgcatgataatccattgaaaggtgcaaatgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgatcgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9167 - DNA, 1560 bp, Streptococcus sp. CM7; identical to SEQ ID NO: 9151
  ref <308>: DATABASE ACCESSION NUMBER: NCBI ACCESSION: NZ_JATP01000009.1
  ref <309>: DATABASE ENTRY DATE: 2019-04-01
  ref <313>: RELEVANT RESIDUES IN SEQ ID NO: (1)..(1560)

SEQ ID NO: 9168 - DNA, 1552 bp, Streptococcus sp. ChDC B345
  ref <308>: DATABASE ACCESSION NUMBER: NCBI ACCESSION: NZ_CP032621.1
  ref <309>: DATABASE ENTRY DATE: 2019-04-01
  ref <313>: RELEVANT RESIDUES IN SEQ ID NO: (1)..(1552)
ttaatgagagtttgatcctggctcaggacgaacgctggcggcgtgcctaatacatgcaagtagaacgctgaaggaggagcttgcttctccggatgagttgcgaacgggtgagtaacgcgtaggtaacctgcctggtagcgggggataactattggaaacgatagctaataccgcataatagtagatgttgcatgacatttgcttaaaaggtgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaagga

SEQ ID NO: 9169 - DNA, 1552 bp, Streptococcus sp. ChDC B353
  ref <308>: DATABASE ACCESSION NUMBER: NCBI ACCESSION: NZ_RBCK01000002.1
  ref <309>: DATABASE ENTRY DATE: 2019-04-01
  ref <313>: RELEVANT RESIDUES IN SEQ ID NO: (1)..(1552)
ttaatgagagtttgatcctggctcaggacgaacgctggcggcgtgcctaatacatgcaagtagaacgctgaaggaggagcttactcttctggatgagttgcgaacgggtgagtaacgcgtaggtaacctgcctggtagcgggggataactattggaaacgatagctaataccgcataagagtagatgttgcatgacatttgcttaaaaggtgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaagga

SEQ ID NO: 9170 - DNA, 1551 bp, Streptococcus sp. DBCMS
  ref <308>: DATABASE ACCESSION NUMBER: NCBI ACCESSION: NZ_JXRG01000005.1
  ref <309>: DATABASE ENTRY DATE: 2019-04-01
  ref <313>: RELEVANT RESIDUES IN SEQ ID NO: (1)..(1551)
ttaatgagagtttgatcctggctcaggacgaacgctggcggcgtgcctaatacatgcaagtagaacgctgaaggaggagcttgctcttctggatgagttgcgaacgggtgagtaacgcgtaggtaacctgcctggtagcgggggataactattggaaacgatagctaataccgcataagagtagatgttgcatgacatttgcttaaaaggtgcaattgcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctcctttctaagga

SEQ ID NO: 9171 - DNA, 1564 bp, Streptococcus sp. DD04
  ref <308>: DATABASE ACCESSION NUMBER: NCBI ACCESSION: NZ_KQ968984.1
  ref <309>: DATABASE ENTRY DATE: 2019-04-01
  ref <313>: RELEVANT RESIDUES IN SEQ ID NO: (1)..(1564)
ttaatgagagtttgatcctggctcaggacgaacgctggcggcgtgcctaatacatgcaagtggaacgcacgaggtacaccgtagtttactacaccgtactttgtgagtcgcgaacgggtgagtaacgcgtaggtaacctaccttttagcgggggataactattggaaacgatagctaataccgcataagatatcttactgcatggtaagatattaaaagatgcaattgcatcactaagagatggacctgcgttgtattagctagtaggtgaggtaacggctcacctaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccggtgcccgtcctagagataggattttgcttcggcacaccggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9172 - DNA, 1556 bp, Streptococcus sp. DD10
  ref <308>: DATABASE ACCESSION NUMBER: NCBI ACCESSION: NZ_KQ969171.1
  ref <309>: DATABASE ENTRY DATE: 2019-04-01
  ref <313>: RELEVANT RESIDUES IN SEQ ID NO: (1)..(1556)
ttaatgagagtttgatcctggctcaggatgaacgctggcggcgtgcctaatacatgcaagtagaacgctgaaggaaggggcttgcttcttctggaagagttgcgaacgggtgagtaacgcgtaggtaacctgcctgatagcgggggataactattggaaacgatagctaataccgcataacaatttttgttgcatgacaagaatttgaaaggggcaaatgctccactatcagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtaaagaacgagtgtgagagtggaaagttcacactgtgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtatgctttggaaactgtttaacttgagtgcaagaggggagagtggaattccatgtgtagcggtgaaatgcgtagatatatggaggaacacctgtggcgaaagcggctctctggcttgtaactgacgctgaggctcgaaagcgtgggtagcgaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccggtgcccgtcctagagataggattttgcttcggcacaccggtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaacctattaggagccagccgcctaaggtgggatagatgattggggtgaagtcgtaacaaggtagccgtatcggaaggtgcggctggatcacctcctttctaaggaa

SEQ ID NO: 9173 - DNA, 1556 bp, Streptococcus sp. DD11
  ref <308>: DATABASE ACCESSION NUMBER: NCBI ACCESSION: NZ_KQ969400.1
  ref <309>: DATABASE ENTRY DATE: 2019-04-01
  ref <313>: RELEVANT RESIDUES IN SEQ ID NO: (1)..(1556)
ttaatgagagtttgatcctggctcaggacgaacgctggcggcgtgcctaatacatgcaagtagaacgctgaaggagggagcttgcttcttccggaagagttgcgaacgggtgagtaacgcgtaggtaacctgcctggcagcgggggataactattggaaacgatagctaataccgcataacaggagcagtcgcatgacagcttcttgaaaggagcaattgctccgctgccagatggacctgcgttgtattagctggttggtgaggtaacggctcaccaaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacggatgtgagagtggaaagctcatattgtgacggtatcttaccagaaagggacggctaactacgtgccagcagccgcggtaatacgtaggtcccgagcgttgtccggatttattgggcgtaaagcgagcgcaggcggttagataagtctgaagtgaaaggctgtggcttaaccatagtatgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattggaggctgcaactcgcctccatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9174 - DNA, 1554 bp, Streptococcus sp. DD12
  ref <308>: DATABASE ACCESSION NUMBER: NCBI ACCESSION: NZ_KQ969499.1
  ref <309>: DATABASE ENTRY DATE: 2019-04-01
  ref <313>: RELEVANT RESIDUES IN SEQ ID NO: (1)..(1554)
aatgagagtttgatcctggctcaggacgaacgctggcggcatgcctaatacatgcaagtagaacgctgaaggaaggagcttgcttcttctggaagagttgcgaacgggtgagtaacgcgtaggtaacctacctgatagcgggggataactattggaaacgatagctaataccgcataacagtttagaacacatgttgtaaacttgaaaggtgcaaatgcatcactatcagatggacctgcgttgtattagctagttggtgaggtaaaggctcaccaaggcaacgatacatagccgacctgagagggtgatcggccacactgggactgagacacggcccagactcctacgggaggcagcagtagggaatcttcggcaatgggggcaaccctgaccgagcaatgccgcgtgagtgaagaaggttttcggatcgtaaagctctgttgtaagggaagaacgttgtgtagagtggaaagttacacaagtgacggtaccttaccagaaagggacggctaactacgtgccagcagccgcggtaatacgtaggtcccgagcgttgtccggatttattgggcgtaaagggagcgcaggcggtttaataagtctgaagttaaaggctgtggctcaaccatagttcgctttggaaactgttaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgccctagagatagggtttcccttcggggcagaggtgacaggtggtgcatggttgtcgtcagctcgtgtcgtgagatgttgggttaagtcccgcaacgagcgcaacccttattgttagttgccatcatttagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccaaagtcggtgaggtaaccttttaggagccagccgcctaaggtgggatagatgattggggtgaagtcgtaacaaggtagccgtaggagaacctgcggctggatcacctcctttctaaggaa

SEQ ID NO: 9175 - DNA, 1552 bp, Streptococcus sp. DD13
  ref <308>: DATABASE ACCESSION NUMBER: NCBI ACCESSION: NZ_KQ969510.1
  ref <309>: DATABASE ENTRY DATE: 2019-04-01
  ref <313>: RELEVANT RESIDUES IN SEQ ID NO: (1)..(1552)
aatgagagtttgatcctggctcaggacgaacgctggcggcgtgcctaatacatgcaagtagaacgctgaaagaaggagcttgcttcttctggatgagttgcgaacgggtgagtaacgcgtaggtaacctgcctggtagcgggggataactattggaaacgatagctaataccgcatgacaatggaagacacatgttttctatttaaaaggagcaattgcttcactaccagatggacctgcgttgtattagctagttggtagggtaacggcctaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccaagcgttgtccggatttattgggcgtaaagcgagcgcaggcggttagataagtctggagtaaaaggctatggctcaaccatagtgtgctctggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccaccctagagatagggtttcccttcggggcagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctcctttctaagga

SEQ ID NO: 9176 - DNA, 1554 bp, Streptococcus sp. F0441
  ref <308>: DATABASE ACCESSION NUMBER: NCBI ACCESSION: NZ_KB373321.1
  ref <309>: DATABASE ENTRY DATE: 2019-04-01
  ref <313>: RELEVANT RESIDUES IN SEQ ID NO: (1)..(1554)
ttaatgagagtttgatcctggctcaggacgaacgctggcggcgtgcctaatacatgcaagtagaacgctgaagcttggtgcttgcaccgagcggatgagttgcgaacgggtgagtaacgcgtaggtaacctgcctggtagcgggggataactattggaaacgatagctaataccgcataaaatggattatcgcatgataatccattgaaaggtgcaaatgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagccggtgacggtaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaagga

SEQ ID NO: 9177 - DNA, 1556 bp, Streptococcus sp. F0442
  ref <308>: DATABASE ACCESSION NUMBER: NCBI ACCESSION: NZ_KB373314.1
  ref <309>: DATABASE ENTRY DATE: 2019-04-01
  ref <313>: RELEVANT RESIDUES IN SEQ ID NO: (1)..(1556)
ttaatgagagtttgatcctggctcaggatgaacgctggcggcgtgcctaatacatgcaagtagaacgctgaagcttggtgcttgcaccgagcggatgagttgcgaacgggtgagtaacgcgtaggtaacctgcctggtagcgggggataactattggaaacgatagctaataccgcataacagtagatattgcatgatatctgcttgaaaggggcaattgctccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattgagttgggcactctagcgagactgccggtaataaaccggaggaaggtggggatgacgtcaaatcatcatgccccttatgacctgggctacacacgtgctacaatggctgggacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggggcggctgggtcaactcctttcttaggaa

SEQ ID NO: 9178 - DNA, 1560 bp, Streptococcus sp. FDAARGOS 146
  ref <308>: DATABASE ACCESSION NUMBER: NCBI ACCESSION: NZ_LOSA02000001.1
  ref <309>: DATABASE ENTRY DATE: 2019-04-01
  ref <313>: RELEVANT RESIDUES IN SEQ ID NO: (1)..(1560)
atgagagtttgatcctggctcaggacgaacgctggcggcgtgcctaatacatgcaagtagaacgcacaggatgcaccgtagtttactacaccgtatcctgtgagttgcgaacgggtgagtaacgcgtaggtaacctgcctggtagcgggggataactattggaaacgatagctaataccgcataagaacatttactgcatggtagatgtttaaaaggtgcaaatgcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgtgtgtgagagtggaaagttcacacagtgacggtacttaaccagaaagggacggctaactacgtgccagcagccgcggtaatacgtaggtcccgagcgttgtccggatttattgggcgtaaagcgagcgcaggcggttagataagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccactctagagatagagtttcccttcggggcagaggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9179 - DNA, 1555 bp, Streptococcus sp. FDAARGOS 192
  ref <308>: DATABASE ACCESSION NUMBER: NCBI ACCESSION: NZ_CP020431.2
  ref <309>: DATABASE ENTRY DATE: 2019-04-01
  ref <313>: RELEVANT RESIDUES IN SEQ ID NO: (1)..(1555)
ttaatgagagtttgatcctggctcaggacgaacgctggcggcgtgcctaatacatgcaagtagaacgctgaagagaggagcttgctcttcttggatgagttgcgaacgggtgagtaacgcgtaggtaacctgccttgtagcgggggataactattggaaacgatagctaataccgcataacaatgggtgacacatgtcatttatttgaaaggggcaattgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 9180 - DNA, 1552 bp, Streptococcus sp. FDAARGOS 256
  ref <308>: DATABASE ACCESSION NUMBER: NCBI ACCESSION: NZ_NTGM02000001.1
  ref <309>: DATABASE ENTRY DATE: 2019-04-01
  ref <313>: RELEVANT RESIDUES IN SEQ ID NO: (1)..(1552)
ttaatgagagtttgatcctggctcaggacgaacgctggcggcgtgcctaatacatgcaagtagaacgctgaaggaggagcttgctcttctggatgagttgcgaacgggtgagtaacgcgtaggtaacctgcctggtagcgggggataactattggaaacgatagctaataccgcataatagtagatgttgcatgacatttgcttaaaaggtgcaattgcatcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctcctttctaagga

SEQ ID NO: 9181 - DNA, 1555 bp, Streptococcus sp. FDAARGOS 520; identical to SEQ ID NO: 9071
  ref <308>: DATABASE ACCESSION NUMBER: NCBI ACCESSION: NZ_CP033810.1
  ref <309>: DATABASE ENTRY DATE: 2019-04-01
  ref <313>: RELEVANT RESIDUES IN SEQ ID NO: (1)..(1555)

SEQ ID NO: 9182 - DNA, 1555 bp, Streptococcus sp. FDAARGOS 521; identical to SEQ ID NO: 9071
  ref <308>: DATABASE ACCESSION NUMBER: NCBI ACCESSION: NZ_CP033809.1
  ref <309>: DATABASE ENTRY DATE: 2019-04-01
  ref <313>: RELEVANT RESIDUES IN SEQ ID NO: (1)..(1555)

SEQ ID NO: 9183 - DNA, 1555 bp, Streptococcus sp. FDAARGOS 522; identical to SEQ ID NO: 9071
  ref <308>: DATABASE ACCESSION NUMBER: NCBI ACCESSION: NZ_CP033808.1
  ref <309>: DATABASE ENTRY DATE: 2019-04-01
  ref <313>: RELEVANT RESIDUES IN SEQ ID NO: (1)..(1555)

SEQ ID NO: 9184 - DNA, 1351 bp, Streptococcus sp. GMD1S
  ref <308>: DATABASE ACCESSION NUMBER: NCBI ACCESSION: NZ_AJQY01000340.1
  ref <309>: DATABASE ENTRY DATE: 2019-04-01
  ref <313>: RELEVANT RESIDUES IN SEQ ID NO: (1)..(1351)
ttaaaaggtgcaattgcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9185 - DNA, 1351 bp, Streptococcus sp. GMD2S; identical to SEQ ID NO: 9184
  ref <308>: DATABASE ACCESSION NUMBER: NCBI ACCESSION: NZ_AJRA01000417.1
  ref <309>: DATABASE ENTRY DATE: 2019-04-01
  ref <313>: RELEVANT RESIDUES IN SEQ ID NO: (1)..(1351)

SEQ ID NO: 9186 - DNA, 1553 bp, Streptococcus sp. GMD3S
  ref <308>: DATABASE ACCESSION NUMBER: NCBI ACCESSION: NZ_AJRC02000056.1
  ref <309>: DATABASE ENTRY DATE: 2019-04-01
  ref <313>: RELEVANT RESIDUES IN SEQ ID NO: (1)..(1553)
ttaatgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataagagtagatgttgcatgacatttgcttaaaaggtgcaattgcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9187 - DNA, 1351 bp, Streptococcus sp. GMD4S; identical to SEQ ID NO: 9184
  ref <308>: DATABASE ACCESSION NUMBER: NCBI ACCESSION: NZ_AJRE01000457.1
  ref <309>: DATABASE ENTRY DATE: 2019-04-01
  ref <313>: RELEVANT RESIDUES IN SEQ ID NO: (1)..(1351)

SEQ ID NO: 9188 - DNA, 1351 bp, Streptococcus sp. GMD5S; identical to SEQ ID NO: 9184
  ref <308>: DATABASE ACCESSION NUMBER: NCBI ACCESSION: NZ_AJRG02000068.1
  ref <309>: DATABASE ENTRY DATE: 2019-04-01
  ref <313>: RELEVANT RESIDUES IN SEQ ID NO: (1)..(1351)

SEQ ID NO: 9189 - DNA, 1351 bp, Streptococcus sp. GMD6S; identical to SEQ ID NO: 9184
  ref <308>: DATABASE ACCESSION NUMBER: NCBI ACCESSION: NZ_AJRH01000293.1
  ref <309>: DATABASE ENTRY DATE: 2019-04-01
  ref <313>: RELEVANT RESIDUES IN SEQ ID NO: (1)..(1351)

SEQ ID NO: 9190 - DNA, 1560 bp, Streptococcus sp. HMSC034A12
  ref <308>: DATABASE ACCESSION NUMBER: NCBI ACCESSION: NZ_KV825760.1
  ref <309>: DATABASE ENTRY DATE: 2019-04-01
  ref <313>: RELEVANT RESIDUES IN SEQ ID NO: (1)..(1560)
atgagagtttgatcctggctcaggacgaacgctggcggcgtgcctaatacatgcaagtaggacgcacagtttataccgtagcttgctacaccatagactgtgagttgcgaacgggtgagtaacgcgtaggtaacctacctattagagggggataactattggaaacgatagctaataccgcataacagtatgtaacacatgttagatgcttgaaagatgcaattgcatcgctagtagatggacctgcgttgtattagctagtaggtagggtaatggcctacctaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgagtgtgagaatggaaagttcatgctgtgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccagtgactgccctagagatagggtttcccttcggggcactggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9191 - DNA, 1560 bp, Streptococcus sp. HMSC034B03
  ref <308>: DATABASE ACCESSION NUMBER: NCBI ACCESSION: NZ_KV837636.1
  ref <309>: DATABASE ENTRY DATE: 2019-04-01
  ref <313>: RELEVANT RESIDUES IN SEQ ID NO: (1)..(1560)
atgagagtttgatcctggctcaggacgaacgctggcggcgtgcctaatacatgcaagtaggacgcacagtttataccgtagcttgctacaccatagactgtgagttgcgaacgggtgagtaacgcgtaggtaacctgcctattagagggggataactattggaaacgatagctaataccgcataacagtatgtaacacatgttagatgcttgaaagatgcaattgcatcgctagtagatggacctgcgttgtattagctagtaggtagggtaaaggcctacctaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgagtgtgagaatggaaagttcatactgtgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagataggaagtttcttcggaacatcggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9192 - DNA, 1560 bp, Streptococcus sp. HMSC034B04
  ref <308>: DATABASE ACCESSION NUMBER: NCBI ACCESSION: NZ_KV825855.1
  ref <309>: DATABASE ENTRY DATE: 2019-04-01
  ref <313>: RELEVANT RESIDUES IN SEQ ID NO: (1)..(1560)
atgagagtttgatcctggctcaggacgaacgctggcggcgtgcctaatacatgcaagtaggacgcacagtttataccgtagcttgctacaccatagactgtgagttgcgaacgggtgagtaacgcgtaggtaacctacctattagagggggataactattggaaacgatagctaataccgcataacagtatgtaacacatgttagatgcttgaaagatgcaattgcatcgctagtagatggacctgcgttgtattagctagtaggtagggtaatggcctacctaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgagtgtgagaatggaaagttcatgctgtgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccagtgactgccctagagatagggttttccttcggggcactggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9193 - DNA, 1560 bp, Streptococcus sp. HMSC034B05; identical to SEQ ID NO: 9178
  ref <308>: DATABASE ACCESSION NUMBER: NCBI ACCESSION: NZ_KV795596.1
  ref <309>: DATABASE ENTRY DATE: 2019-04-01
  ref <313>: RELEVANT RESIDUES IN SEQ ID NO: (1)..(1560)

SEQ ID NO: 9194 - DNA, 1348 bp, Streptococcus sp. HMSC034E03
  ref <308>: DATABASE ACCESSION NUMBER: NCBI ACCESSION: NZ_KV804920.1
  ref <309>: DATABASE ENTRY DATE: 2019-04-01
  ref <313>: RELEVANT RESIDUES IN SEQ ID NO: (1)..(1348)
aaaggtgcaattgcatcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgatcgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9195 - DNA, 1560 bp, Streptococcus sp. HMSC034E12; identical to SEQ ID NO: 9190
  ref <308>: DATABASE ACCESSION NUMBER: NCBI ACCESSION: NZ_KV826474.1
  ref <309>: DATABASE ENTRY DATE: 2019-04-01
  ref <313>: RELEVANT RESIDUES IN SEQ ID NO: (1)..(1560)

SEQ ID NO: 9196 - DNA, 1560 bp, Streptococcus sp. HMSC034F02; identical to SEQ ID NO: 9190
  ref <308>: DATABASE ACCESSION NUMBER: NCBI ACCESSION: NZ_KV826495.1
  ref <309>: DATABASE ENTRY DATE: 2019-04-01
  ref <313>: RELEVANT RESIDUES IN SEQ ID NO: (1)..(1560)

SEQ ID NO: 9197 - DNA, 1127 bp, Streptococcus sp. HMSC034F03
  ref <308>: DATABASE ACCESSION NUMBER: NCBI ACCESSION: NZ_KV837448.1
  ref <309>: DATABASE ENTRY DATE: 2019-04-01
  ref <313>: RELEVANT RESIDUES IN SEQ ID NO: (1)..(1127)
atgagagtttgatcctggctcaggacgaacgctggcggcgtgcctaatacatgcaagtaggacgcacagtttataccgtagcttgctacaccatagactgtgagttgcgaacgggtgagtaacgcgtaggtaacctacctattagagggggataactattggaaacgatagctaataccgcataacagtatgtaacacatgttagatgcttgaaagatgcaattgcatcgctagtagatggacctgcgttgtattagctagtaggtagggtaatggcctacctaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgagtgtgagaatggaaagttcatgctgtgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccagtgactgccctagagatagggtttcccttcggggcactggtgacaggtggtgcatggttgtcgtcagctcgtgtcgtgagatgttgggttaagtcccgcaacgagcgcaaccctt

SEQ ID NO: 9198 - DNA, 1555 bp, Streptococcus sp. HMSC036H09; identical to SEQ ID NO: 9071
  ref <308>: DATABASE ACCESSION NUMBER: NCBI ACCESSION: NZ_KV827885.1
  ref <309>: DATABASE ENTRY DATE: 2019-04-01
  ref <313>: RELEVANT RESIDUES IN SEQ ID NO: (1)..(1555)

SEQ ID NO: 9199 - DNA, 1555 bp, Streptococcus sp. HMSC056B03; identical to SEQ ID NO: 9071
  ref <308>: DATABASE ACCESSION NUMBER: NCBI ACCESSION: NZ_KV828153.1
  ref <309>: DATABASE ENTRY DATE: 2019-04-01
  ref <313>: RELEVANT RESIDUES IN SEQ ID NO: (1)..(1555)

SEQ ID NO: 9200 - DNA, 1269 bp, Streptococcus sp. HMSC056C01
  ref <308>: DATABASE ACCESSION NUMBER: NCBI ACCESSION: NZ_KV804179.1
  ref <309>: DATABASE ENTRY DATE: 2019-04-01
  ref <313>: RELEVANT RESIDUES IN SEQ ID NO: (1)..(1269)
ttaatgagagtttgatcctggctcaggacgaacgctggcggcgtgcctaatacatgcaagtagaacgctgaaggaggagcttgcttctccggatgagttgcgaacgggtgagtaacgcgtaggtaacctgcctggtagcgggggataactattggaaacgatagctaataccgcataacagtagatattgcatgatatctgcttgaaaggtgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccactctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcgg

SEQ ID NO: 9201 - DNA, 1555 bp, Streptococcus sp. HMSC056D01
  ref <308>: DATABASE ACCESSION NUMBER: NCBI ACCESSION: NZ_KV828195.1
  ref <309>: DATABASE ENTRY DATE: 2019-04-01
  ref <313>: RELEVANT RESIDUES IN SEQ ID NO: (1)..(1555)
ttaatgagagtttgatcctggctcaggacgaacgctggcggcgtgcctaatacatgcaagtagaacgctgatgtttggtgtttacactagactgatgagttgcgaacgggtgagtaacgcgtaggtaacctgcctcatagcgggggataactattggaaacgatagctaataccgcataagagtgattaacacatgttagttatttaaaaggagcaattgcttcactgtgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacgttggtaggagtggaaaatctaccaagtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9202 - DNA, 1560 bp, Streptococcus sp. HMSC056D07; identical to SEQ ID NO: 9190
  ref <308>: DATABASE ACCESSION NUMBER: NCBI ACCESSION: NZ_KV816595.1
  ref <309>: DATABASE ENTRY DATE: 2019-04-01
  ref <313>: RELEVANT RESIDUES IN SEQ ID NO: (1)..(1560)

SEQ ID NO: 9203 - DNA, 1560 bp, Streptococcus sp. HMSC057E02
  ref <308>: DATABASE ACCESSION NUMBER: NCBI ACCESSION: NZ_KV802535.1
  ref <309>: DATABASE ENTRY DATE: 2019-04-01
  ref <313>: RELEVANT RESIDUES IN SEQ ID NO: (1)..(1560)
atgagagtttgatcctggctcaggacgaacgctggcggcgtgcctaatacatgcaagtaggacgcacagtttataccgtagcttgctacaccatagactgtgagttgcgaacgggtgagtaacgcgtaggtaacctgcctattagagggggataactattggaaacgatagctaataccgcataacagtatgtaacacatgttagatgcttgaaagatgcaattgcatcgctagtagatggacctgcgttgtattagctagtaggtagggtaatggcctacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgagtgtgagaatggaaagttcatactgtgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagataggaagtttcttcggaacatcggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9204 - DNA, 514 bp, Streptococcus sp. HMSC057F04
  ref <308>: DATABASE ACCESSION NUMBER: NCBI ACCESSION: NZ_KV814669.1
  ref <309>: DATABASE ENTRY DATE: 2019-04-01
  ref <313>: RELEVANT RESIDUES IN SEQ ID NO: (1)..(514)
ttaatgagagtttgatcctggctcaggacgaacgctggcggcgtgcctaatacatgcaagtagaacgctgaggtttggtgtttacactagactgatgagttgcgaacgggtgagtaacgcgtaggtaacctgcctcatagcgggggataactattggaaacgatagctaataccgcataagagtaattaacacatgttggttatttaaaaggagcaattgcttcactgtgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacgttggtaggagtggaaaatctaccaagtgacggtaactaaccagaaagggacggct

SEQ ID NO: 9205 - DNA, 1555 bp, Streptococcus sp. HMSC057G03
  ref <308>: DATABASE ACCESSION NUMBER: NCBI ACCESSION: NZ_KV794413.1
  ref <309>: DATABASE ENTRY DATE: 2019-04-01
  ref <313>: RELEVANT RESIDUES IN SEQ ID NO: (1)..(1555)
ttaatgagagtttgatcctggctcaggatgaacgctggcggcgtgcctaatacatgcaagtagaacgctgaagcttggtgcttgcaccgagcggatgagttgcgaacgggtgagtaacgcgtaggtaacctgcctcttagcgggggataactattggaaacgatagctaataccgcataaaagtcgatatcgcatgatattgatttgaaaggtgcaattgcatcactaagagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9206 - DNA, 1560 bp, Streptococcus sp. HMSC061D01; identical to SEQ ID NO: 9151
  ref <308>: DATABASE ACCESSION NUMBER: NCBI ACCESSION: NZ_KV802484.1
  ref <309>: DATABASE ENTRY DATE: 2019-04-01
  ref <313>: RELEVANT RESIDUES IN SEQ ID NO: (1)..(1560)

SEQ ID NO: 9207 - DNA, 1553 bp, Streptococcus sp. HMSC061D10
  ref <308>: DATABASE ACCESSION NUMBER: NCBI ACCESSION: NZ_KV795006.1
  ref <309>: DATABASE ENTRY DATE: 2019-04-01
  ref <313>: RELEVANT RESIDUES IN SEQ ID NO: (1)..(1553)
ttaatgagagtttgatcctggctcaggacgaacgctggcggcgtgcctaatacatgcaagtagaacgctgaaggaggagcttgcttctccggatgagttgcgaacgggtgagtaacgcgtaggtaacctgcctggtagcgggggataactattggaaacgatagctaataccgcataacagtagatattgcatgatatctgcttgaaaggtgcaattgcatcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9208 - DNA, 617 bp, Streptococcus sp. HMSC061E03
  ref <308>: DATABASE ACCESSION NUMBER: NCBI ACCESSION: NZ_KV812799.1
  ref <309>: DATABASE ENTRY DATE: 2019-04-01
  ref <313>: RELEVANT RESIDUES IN SEQ ID NO: (1)..(617)
gcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattgagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9209 - DNA, 1562 bp, Streptococcus sp. HMSC062B01
  ref <308>: DATABASE ACCESSION NUMBER: NCBI ACCESSION: NZ_KZ672772.1
  ref <309>: DATABASE ENTRY DATE: 2019-04-01
  ref <313>: RELEVANT RESIDUES IN SEQ ID NO: (1)..(1562)
aatgagagtttgatcctggctcaggacgaacgctggcggcgtgcctaatacatgcaagtagaacgcacagtttataccgtagcttgctacaccatagactgtgagttgcgaacgggtgagtaacgcgtaggtaacctgcctggtagcgggggataactattggaaacgatagctaataccgcataatattaattattgcatgataattgattaaaaggtgcaattgcaccactaccagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtaagagaagaacgggtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9210 - DNA, 1554 bp, Streptococcus sp. HMSC062D07
  ref <308>: DATABASE ACCESSION NUMBER: NCBI ACCESSION: NZ_KV815320.1
  ref <309>: DATABASE ENTRY DATE: 2019-04-01
  ref <313>: RELEVANT RESIDUES IN SEQ ID NO: (1)..(1554)
ttaatgagagtttgatcctggctcaggacgaacgctggcggcgtgcctaatacatgcaagtagaacgctgaaggaggagcttgctctttccggatgagttgcgaacgggtgagtaacgcgtaggtaacctgcctggtagcgggggataactattggaaacgatagctaataccgcataagagtagatatcgcatgatagctgcttgaaaggtgcaattgcaccactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9211 - DNA, 1555 bp, Streptococcus sp. HMSC062H02
  ref <308>: DATABASE ACCESSION NUMBER: NCBI ACCESSION: NZ_KV811104.1
  ref <309>: DATABASE ENTRY DATE: 2019-04-01
  ref <313>: RELEVANT RESIDUES IN SEQ ID NO: (1)..(1555)
ttttaatgagagtttgatcctggctcaggacgaacgctggcggcgtgcctaatacatgcaagtagaacgctgaaggaggagcttgctcttctggatgagttgcgaacgggtgagtaacgcgtaggtaacctgcctggtagcgggggataactattggaaacgatagctaataccgcataatagtagatgttgcatgacatttgcttaaaaggtgcaattgcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9212 - DNA, 1552 bp, Streptococcus sp. HMSC063B03
  ref <308>: DATABASE ACCESSION NUMBER: NCBI ACCESSION: NZ_KV831014.1
  ref <309>: DATABASE ENTRY DATE: 2019-04-01
  ref <313>: RELEVANT RESIDUES IN SEQ ID NO: (1)..(1552)
ttaatgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataatagtagatgttgcatgacatttgcttaaaaggtgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaagga

SEQ ID NO: 9213 - DNA, 1555 bp, Streptococcus sp. HMSC063D10; identical to SEQ ID NO: 9071
  ref <308>: DATABASE ACCESSION NUMBER: NCBI ACCESSION: NZ_KV794049.1
  ref <309>: DATABASE ENTRY DATE: 2019-04-01
  ref <313>: RELEVANT RESIDUES IN SEQ ID NO: (1)..(1555)

SEQ ID NO: 9214 - DNA, 1555 bp, Streptococcus sp. HMSC064D12
  ref <308>: DATABASE ACCESSION NUMBER: NCBI ACCESSION: NZ_KV831724.1
  ref <309>: DATABASE ENTRY DATE: 2019-04-01
  ref <313>: RELEVANT RESIDUES IN SEQ ID NO: (1)..(1555)
ttaatgagagtttgatcctggctcaggacgaacgctggcggcgtgcctaatacatgcaagtagaacgctgaagagaggagcttgctcttcttggatgagttgcgaacgggtgagtaacgcgtaggtaacctgccttgtagcgggggataactattggaaacgatagctaataccgcataacaatggatgactcatgtcatttatttgaaaggggcaaatgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 9215 - DNA, 1555 bp, Streptococcus sp. HMSC064H02; identical to SEQ ID NO: 9071
  ref <308>: DATABASE ACCESSION NUMBER: NCBI ACCESSION: NZ_KV831937.1
  ref <309>: DATABASE ENTRY DATE: 2019-04-01
  ref <313>: RELEVANT RESIDUES IN SEQ ID NO: (1)..(1555)

SEQ ID NO: 9216 - DNA, 1555 bp, Streptococcus sp. HMSC064H09; identical to SEQ ID NO: 9136
  ref <308>: DATABASE ACCESSION NUMBER: NCBI ACCESSION: NZ_KV809553.1
  ref <309>: DATABASE ENTRY DATE: 2019-04-01
  ref <313>: RELEVANT RESIDUES IN SEQ ID NO: (1)..(1555)

SEQ ID NO: 9217 - DNA, 1555 bp, Streptococcus sp. HMSC065C01
  ref <308>: DATABASE ACCESSION NUMBER: NCBI ACCESSION: NZ_KV812818.1
  ref <309>: DATABASE ENTRY DATE: 2019-04-01
  ref <313>: RELEVANT RESIDUES IN SEQ ID NO: (1)..(1555)
ttaatgagagtttgatcctggctcaggatgaacgctggcggcgtgcctaatacatgcaagtagaacgctgaagcttggtgcttgcaccgagcggatgagttgcgaacgggtgagtaacgcgtaggtaacctgcctcttagcgggggataactattggaaacgatagctaataccgcataaaagtcgatatcgcatgatattgatttgaaaggtgcaattgcatcactaagagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9218 - DNA, 1374 bp, Streptococcus sp. HMSC065E03
  ref <308>: DATABASE ACCESSION NUMBER: NCBI ACCESSION: NZ_KV818836.1
  ref <309>: DATABASE ENTRY DATE: 2019-04-01
  ref <313>: RELEVANT RESIDUES IN SEQ ID NO: (1)..(1374)
agtcgacatcgcatgatgttgacttgaaaggtgcaattgcatcactaagagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctcctttctaaggaa

SEQ ID NO: 9219 - DNA, 1536 bp, Streptococcus sp. HMSC065G04
  ref <308>: DATABASE ACCESSION NUMBER: NCBI ACCESSION: NZ_KV816252.1
  ref <309>: DATABASE ENTRY DATE: 2019-04-01
  ref <313>: RELEVANT RESIDUES IN SEQ ID NO: (1)..(1536)
ttaatgagagtttgatcctggctcaggacgaacgctggcggcgtgcctaatacatgcaagtagaacgctgaggtttggtgtttacactagactgatgagttgcgaacgggtgagtaacgcgtaggtaacctgcctcatagcgggggataactattggaaacgatagctaataccgcataagagtaattaacacatgttagttatttaaaaggagcaattgcttcactgtgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacgttggtaggagtggaaaatctaccaagtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctgg

SEQ ID NO: 9220 - DNA, 1555 bp, Streptococcus sp. HMSC065H07; identical to SEQ ID NO: 9136
  ref <308>: DATABASE ACCESSION NUMBER: NCBI ACCESSION: NZ_KV832012.1
  ref <309>: DATABASE ENTRY DATE: 2019-04-01
  ref <313>: RELEVANT RESIDUES IN SEQ ID NO: (1)..(1555)

SEQ ID NO: 9221 - DNA, 1554 bp, Streptococcus sp. HMSC066E07
  ref <308>: DATABASE ACCESSION NUMBER: NCBI ACCESSION: NZ_KV817450.1
  ref <309>: DATABASE ENTRY DATE: 2019-04-01
  ref <313>: RELEVANT RESIDUES IN SEQ ID NO: (1)..(1554)
atgagagtttgatcctggctcaggacgaacgctggcggcgtgcctaatacatgcaagtaggacgcacagtttataccgtagcttgctacaccatagactgtgagttgcgaacgggtgagtaacgcgtaggtaacctgcctattagagggggataactattggaaacgatagctaataccgcataacagtatgtaacacatgttagatgcttgaaagatgcaattgcatcgctagtagatggacctgcgttgtattagctagtaggtagggtaatggcctacctaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgagtgtgagaatggaaagttcatactgtgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagataggaagtttcttcggaacatcggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttct

SEQ ID NO: 9222 - DNA, 1552 bp, Streptococcus sp. HMSC066F01
  ref <308>: DATABASE ACCESSION NUMBER: NCBI ACCESSION: NZ_KV832092.1
  ref <309>: DATABASE ENTRY DATE: 2019-04-01
  ref <313>: RELEVANT RESIDUES IN SEQ ID NO: (1)..(1552)
ttaatgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataatagtagatgttgcatgacatttgcttaaaaggtgcaattgcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctcctttctaagga

SEQ ID NO: 9223 - DNA, 1560 bp, Streptococcus sp. HMSC066F10; identical to SEQ ID NO: 9190
  ref <308>: DATABASE ACCESSION NUMBER: NCBI ACCESSION: NZ_KV813961.1
  ref <309>: DATABASE ENTRY DATE: 2019-04-01
  ref <313>: RELEVANT RESIDUES IN SEQ ID NO: (1)..(1560)

SEQ ID NO: 9224 - DNA, 1560 bp, Streptococcus sp. HMSC067A03
  ref <308>: DATABASE ACCESSION NUMBER: NCBI ACCESSION: NZ_KV815645.1
  ref <309>: DATABASE ENTRY DATE: 2019-04-01
  ref <313>: RELEVANT RESIDUES IN SEQ ID NO: (1)..(1560)
atgagagtttgatcctggctcaggacgaacgctggcggcgtgcctaatacatgcaagtagaacgcacaggatgcaccgtagtttactacaccgtattctgtgagttgcgaacgggtgagtaacgcgtaggtaacctgcctggtagcgggggataactattggaaacgatagctaataccgcataagaacatttactgcatggtagatgtttaaaaggtgcaagagcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgtgtgtgagagtggaaagttcacacagtgacggtacttaaccagaaagggacggctaactacgtgccagcagccgcggtaatacgtaggtcccgagcgttgtccggatttattgggcgtaaagcgagcgcaggcggttagataagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccactctagagatagagtttcccttcggggcagaggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtggggtaaccgtaaggagccagccgcctaaggtgggatagatgattggggtgaagtcgtaacaaggtagccgtatcggaaggtgcggctggatcacctcctttctaaggaa

SEQ ID NO: 9225 - DNA, 1553 bp, Streptococcus sp. HMSC067H01
  ref <308>: DATABASE ACCESSION NUMBER: NCBI ACCESSION: NZ_KV817770.1
  ref <309>: DATABASE ENTRY DATE: 2019-04-01
  ref <313>: RELEVANT RESIDUES IN SEQ ID NO: (1)..(1553)
ttaatgagagtttgatcctggctcaggacgaacgctggcggcgtgcctaatacatgcaagtagaacgctgaaggaggagcttgcttctccggatgagttgcgaacgggtgagtaacgcgtaggtaacctgcctggtagcgggggataactattggaaacgatagctaataccgcataacagtagatattgcatgatatctgcttgaaaggtgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgacctctctagagatagagatttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagtcggtgacgacaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9226 - DNA, 1555 bp, Streptococcus sp. HMSC068F04; identical to SEQ ID NO: 9214
  ref <308>: DATABASE ACCESSION NUMBER: NCBI ACCESSION: NZ_KV832468.1
  ref <309>: DATABASE ENTRY DATE: 2019-04-01
  ref <313>: RELEVANT RESIDUES IN SEQ ID NO: (1)..(1555)

SEQ ID NO: 9227 - DNA, 1555 bp, Streptococcus sp. HMSC068H01; identical to SEQ ID NO: 9071
  ref <308>: DATABASE ACCESSION NUMBER: NCBI ACCESSION: NZ_KV794020.1
  ref <309>: DATABASE ENTRY DATE: 2019-04-01
  ref <313>: RELEVANT RESIDUES IN SEQ ID NO: (1)..(1555)

SEQ ID NO: 9228 - DNA, 1555 bp, Streptococcus sp. HMSC069D09; identical to SEQ ID NO: 9071
  ref <308>: DATABASE ACCESSION NUMBER: NCBI ACCESSION: NZ_KV793850.1
  ref <309>: DATABASE ENTRY DATE: 2019-04-01
  ref <313>: RELEVANT RESIDUES IN SEQ ID NO: (1)..(1555)

SEQ ID NO: 9229 - DNA, 1555 bp, Streptococcus sp. HMSC070A10
  ref <308>: DATABASE ACCESSION NUMBER: NCBI ACCESSION: NZ_KV806476.1
  ref <309>: DATABASE ENTRY DATE: 2019-04-01
  ref <313>: RELEVANT RESIDUES IN SEQ ID NO: (1)..(1555)
ttaatgagagtttgatcctggctcaggacgaacgctggcggcgtgcctaatacatgcaagtagaacgctgaggtttggtgtttacactagactgatgagttgcgaacgggtgagtaacgcgtaggtaacctgcctcatagcgggggataactattggaaacgatagctaataccgcataagagtaattaacacatgttggttatttaaaaggagcaattgcttcactgtgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacgttggtaggagtggaaaatctaccaagtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9230 - DNA, 1555 bp, Streptococcus sp. HMSC070B09; identical to SEQ ID NO: 9229
  ref <308>: DATABASE ACCESSION NUMBER: NCBI ACCESSION: NZ_KV810047.1
  ref <309>: DATABASE ENTRY DATE: 2019-04-01
  ref <313>: RELEVANT RESIDUES IN SEQ ID NO: (1)..(1555)

SEQ ID NO: 9231 - DNA, 1510 bp, Streptococcus sp. HMSC070B10
  ref <308>: DATABASE ACCESSION NUMBER: NCBI ACCESSION: NZ_KV794154.1
  ref <309>: DATABASE ENTRY DATE: 2019-04-01
  ref <313>: RELEVANT RESIDUES IN SEQ ID NO: (1)..(1510)
tgcctaatacatgcaagtagaacgctgaaggaggagcttgcttctctggatgagttgcgaacgggtgagtaacgcgtaggtaacctgcctggtagcgggggataactattggaaacgatagctaataccgcataatagtagatgttgcatgacatttgcttaaaaggtgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9232 - DNA, 1553 bp, Streptococcus sp. HMSC071D03
  ref <308>: DATABASE ACCESSION NUMBER: NCBI ACCESSION: NZ_KV807687.1
  ref <309>: DATABASE ENTRY DATE: 2019-04-01
  ref <313>: RELEVANT RESIDUES IN SEQ ID NO: (1)..(1553)
ttaatgagagtttgatcctggctcaggacgaacgctggcggcgtgcctaatacatgcaagtagaacgctgaaggaggagcttgctcttctggatgagttgcgaacgggtgagtaacgcgtaggtaacctgcctggtagcgggggataactattggaaacgatagctaataccgcataacagtagatattgcatgatatctgcttgaaaggtgcaattgcatcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgacctctctagagatagagatttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9233 - DNA, 1221 bp, Streptococcus sp. HMSC071H03
  ref <308>: DATABASE ACCESSION NUMBER: NCBI ACCESSION: NZ_KV811151.1
  ref <309>: DATABASE ENTRY DATE: 2019-04-01
  ref <313>: RELEVANT RESIDUES IN SEQ ID NO: (1)..(1221)
atgagagtttgatcctggctcaggacgaacgctggcggcgtgcctaatacatgcaagtaggacgcacagtttataccgtagcttgctacaccatagactgtgagttgcgaacgggtgagtaacgcgtaggtaacctgcctattagagggggataactattggaaacgatagctaataccgcataacagtatgtaacacatgttagatgcttgaaagatgcaattgcatcgctagtagatggacctgcgttgtattagctagtaggtagggtaaaggcctacctaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgagtgtgagaatggaaagttcatactgtgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagataggaagtttcttcggaacatcggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgcccct

SEQ ID NO: 9234 - DNA, 1325 bp, Streptococcus sp. HMSC072C09
  ref <308>: DATABASE ACCESSION NUMBER: NCBI ACCESSION: NZ_KV811491.1
  ref <309>: DATABASE ENTRY DATE: 2019-04-01
  ref <313>: RELEVANT RESIDUES IN SEQ ID NO: (1)..(1325)
agatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattgagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9235 - DNA, 709 bp, Streptococcus sp. HMSC072D03
  ref <308>: DATABASE ACCESSION NUMBER: NCBI ACCESSION: NZ_KV810612.1
  ref <309>: DATABASE ENTRY DATE: 2019-04-01
  ref <313>: RELEVANT RESIDUES IN SEQ ID NO: (1)..(709)
ttccgggattcagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgtggctggatcacctcctttctaaggaa

SEQ ID NO: 9236 - DNA, 862 bp, Streptococcus sp. HMSC072D05
  ref <308>: DATABASE ACCESSION NUMBER: NCBI ACCESSION: NZ_KV822007.1
  ref <309>: DATABASE ENTRY DATE: 2019-04-01
  ref <313>: RELEVANT RESIDUES IN SEQ ID NO: (1)..(862)
cggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9237 - DNA, 1552 bp, Streptococcus sp. HMSC072D07
  ref <308>: DATABASE ACCESSION NUMBER: NCBI ACCESSION: NZ_KV818042.1
  ref <309>: DATABASE ENTRY DATE: 2019-04-01
  ref <313>: RELEVANT RESIDUES IN SEQ ID NO: (1)..(1552)
ttaatgagagtttgatcctggctcaggacgaacgctggcggcgtgcctaatacatgcaagtagaacgctgaaggaggagcttgcttctctggatgagttgcgaacgggtgagtaacgcgtaggtaacctacctggtagcgggggataactattggaaacgatagctaataccgcataagagtagatgtcgcatgacatttgcttgaaaggtgcaattgcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctcctttctaagga

SEQ ID NO: 9238 - DNA, 1555 bp, Streptococcus sp. HMSC072E12; identical to SEQ ID NO: 9071
  ref <308>: DATABASE ACCESSION NUMBER: NCBI ACCESSION: NZ_KV803186.1
  ref <309>: DATABASE ENTRY DATE: 2019-04-01
  ref <313>: RELEVANT RESIDUES IN SEQ ID NO: (1)..(1555)

SEQ ID NO: 9239 - DNA, 1555 bp, Streptococcus sp. HMSC072G02; identical to SEQ ID NO: 9071
  ref <308>: DATABASE ACCESSION NUMBER: NCBI ACCESSION: NZ_KV833980.1
  ref <309>: DATABASE ENTRY DATE: 2019-04-01
  ref <313>: RELEVANT RESIDUES IN SEQ ID NO: (1)..(1555)

SEQ ID NO: 9240 - DNA, 1555 bp, Streptococcus sp. HMSC072G04
  ref <308>: DATABASE ACCESSION NUMBER: NCBI ACCESSION: NZ_KV812024.1
  ref <309>: DATABASE ENTRY DATE: 2019-04-01
  ref <313>: RELEVANT RESIDUES IN SEQ ID NO: (1)..(1555)
ttaatgagagtttgatcctggctcaggatgaacgctggcggcgtgcctaatacatgcaagtagaacgctgaagcttggtgcttgcaccgagcggatgagttgcgaacgggtgagtaacgcgtaggtaacctgcctcttagcgggggataactattggaaacgatagctaataccgcataaaagtcgacattgcatgatgttgatttgaaaggtgcaaatgcatcactaagagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattgagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9241 - DNA, 1174 bp, Streptococcus sp. HMSC073A12
  ref <308>: DATABASE ACCESSION NUMBER: NCBI ACCESSION: NZ_KV810521.1
  ref <309>: DATABASE ENTRY DATE: 2019-04-01
  ref <313>: RELEVANT RESIDUES IN SEQ ID NO: (1)..(1174)
gggggaaccctgaccgagcaacgccgcgtgagtgaagaaggttttcggatcgtaaagctctgttgttaaggaagaacgagtgtgagaatggaaagttcatgctgtgacggtacttaaccagaaagggacggctaactacgtgccagcagccgcggtaatacgtaggtcccgagcgttgtccggatttattgggcgtaaagcgagcgcaggcggttagaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggtcctttccgggacttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccagtgactgccctagagatagggtttcccttcggggcactggtgacaggtggtgcatggttgtcgtcagctcgtgtcgtgagatgttgggttaagtcccgcaacgagcgcaacccttattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9242 - DNA, 1165 bp, Streptococcus sp. HMSC073D05
  ref <308>: DATABASE ACCESSION NUMBER: NCBI ACCESSION: NZ_KV807480.1
  ref <309>: DATABASE ENTRY DATE: 2019-04-01
  ref <313>: RELEVANT RESIDUES IN SEQ ID NO: (1)..(1165)
ctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccggggctcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattgagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9243 - DNA, 1173 bp, Streptococcus sp. HMSC073F11
  ref <308>: DATABASE ACCESSION NUMBER: NCBI ACCESSION: NZ_KV802682.1
  ref <309>: DATABASE ENTRY DATE: 2019-04-01
  ref <313>: RELEVANT RESIDUES IN SEQ ID NO: (1)..(1173)
acggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9244 - DNA, 1534 bp, Streptococcus sp. HMSC074B11
  ref <308>: DATABASE ACCESSION NUMBER: NCBI ACCESSION: NZ_KV794257.1
  ref <309>: DATABASE ENTRY DATE: 2019-04-01
  ref <313>: RELEVANT RESIDUES IN SEQ ID NO: (1)..(1534)
ttaatgagagtttgatcctggctcaggacgaacgctggcggcgtgcctaatacatgcaagtagaacgctgaaggaggagcttgcttctccggatgagttgcgaacgggtgagtaacgcgtaggtaacctgcctggtagcgggggataactattggaaacgatagctaataccgcataacagtagatattgcatgatatctgcttaaaaggtgcaattgcatcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctgg

SEQ ID NO: 9245 - DNA, 1555 bp, Streptococcus sp. HMSC074F05
  ref <308>: DATABASE ACCESSION NUMBER: NCBI ACCESSION: NZ_KV794402.1
  ref <309>: DATABASE ENTRY DATE: 2019-04-01
  ref <313>: RELEVANT RESIDUES IN SEQ ID NO: (1)..(1555)
ttaatgagagtttgatcctggctcaggatgaacgctggcggcgtgcctaatacatgcaagtagaacgctgaagcttggtgcttgcaccgagcggatgagttgcgaacgggtgagtaacgcgtaggtaacctgcctcttagcgggggataactattggaaacgatagctaataccgcataaaagtcgatatcgcatgatgttgatttgaaaggtgcaattgcatcactaagagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattgagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9246 - DNA, 1555 bp, Streptococcus sp. HMSC074F09; identical to SEQ ID NO: 9229
  ref <308>: DATABASE ACCESSION NUMBER: NCBI ACCESSION: NZ_KV834243.1
  ref <309>: DATABASE ENTRY DATE: 2019-04-01
  ref <313>: RELEVANT RESIDUES IN SEQ ID NO: (1)..(1555)

SEQ ID NO: 9247 - DNA, 1555 bp, Streptococcus sp. HMSC074F10; identical to SEQ ID NO: 9071
  ref <308>: DATABASE ACCESSION NUMBER: NCBI ACCESSION: NZ_KV794559.1
  ref <309>: DATABASE ENTRY DATE: 2019-04-01
  ref <313>: RELEVANT RESIDUES IN SEQ ID NO: (1)..(1555)

SEQ ID NO: 9248 - DNA, 1555 bp, Streptococcus sp. HMSC075A03; identical to SEQ ID NO: 9071
  ref <308>: DATABASE ACCESSION NUMBER: NCBI ACCESSION: NZ_KV802607.1
  ref <309>: DATABASE ENTRY DATE: 2019-04-01
  ref <313>: RELEVANT RESIDUES IN SEQ ID NO: (1)..(1555)

SEQ ID NO: 9249 - DNA, 1552 bp, Streptococcus sp. HMSC076C08
  ref <308>: DATABASE ACCESSION NUMBER: NCBI ACCESSION: NZ_KV802702.1
  ref <309>: DATABASE ENTRY DATE: 2019-04-01
  ref <313>: RELEVANT RESIDUES IN SEQ ID NO: (1)..(1552)
ttaatgagagtttgatcctggctcaggacgaacgctggcggcgtgcctaatacatgcaagtagaacgctgaaggaggagcttgcttctctggatgagttgcgaacgggtgagtaacgcgtaggtaacctacctggtagcgggggataactattggaaacgatagctaataccgcataagagtagatgtcgcatgacatttgcttgaaaggtgcaattgcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgctgtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctcctttctaagga

SEQ ID NO: 9250 - DNA, 1337 bp, Streptococcus sp. HMSC076C09
  ref <308>: DATABASE ACCESSION NUMBER: NCBI ACCESSION: NZ_KV834612.1
  ref <309>: DATABASE ENTRY DATE: 2019-04-01
  ref <313>: RELEVANT RESIDUES IN SEQ ID NO: (1)..(1337)
tgcatcactaagagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctcctttctaaggaa

SEQ ID NO: 9251 - DNA, 1555 bp, Streptococcus sp. HMSC076D11; identical to SEQ ID NO: 9071
  ref <308>: DATABASE ACCESSION NUMBER: NCBI ACCESSION: NZ_KV794683.1
  ref <309>: DATABASE ENTRY DATE: 2019-04-01
  ref <313>: RELEVANT RESIDUES IN SEQ ID NO: (1)..(1555)

SEQ ID NO: 9252 - DNA, 1044 bp, Streptococcus sp. HMSC076E03
  ref <308>: DATABASE ACCESSION NUMBER: NCBI ACCESSION: NZ_KV793923.1
  ref <309>: DATABASE ENTRY DATE: 2019-04-01
  ref <313>: RELEVANT RESIDUES IN SEQ ID NO: (1)..(1044)
aactaaccagaaagggacggctaactacgtgccagcagccgcggtaatacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctgg

SEQ ID NO: 9253 - DNA, 1555 bp, Streptococcus sp. HMSC076H07; identical to SEQ ID NO: 9229
  ref <308>: DATABASE ACCESSION NUMBER: NCBI ACCESSION: NZ_KV814746.1
  ref <309>: DATABASE ENTRY DATE: 2019-04-01
  ref <313>: RELEVANT RESIDUES IN SEQ ID NO: (1)..(1555)

SEQ ID NO: 9254 - DNA, 1555 bp, Streptococcus sp. HMSC076H08; identical to SEQ ID NO: 9229
  ref <308>: DATABASE ACCESSION NUMBER: NCBI ACCESSION: NZ_KV803480.1
  ref <309>: DATABASE ENTRY DATE: 2019-04-01
  ref <313>: RELEVANT RESIDUES IN SEQ ID NO: (1)..(1555)

SEQ ID NO: 9255 - DNA, 1555 bp, Streptococcus sp. HMSC076H09; identical to SEQ ID NO: 9229
  ref <308>: DATABASE ACCESSION NUMBER: NCBI ACCESSION: NZ_KV806587.1
  ref <309>: DATABASE ENTRY DATE: 2019-04-01
  ref <313>: RELEVANT RESIDUES IN SEQ ID NO: (1)..(1555)

SEQ ID NO: 9256 - DNA, 1555 bp, Streptococcus sp. HMSC076H10; identical to SEQ ID NO: 9229
  ref <308>: DATABASE ACCESSION NUMBER: NCBI ACCESSION: NZ_KV820097.1
  ref <309>: DATABASE ENTRY DATE: 2019-04-01
  ref <313>: RELEVANT RESIDUES IN SEQ ID NO: (1)..(1555)

SEQ ID NO: 9257 - DNA, 1552 bp, Streptococcus sp. HMSC077D04
  ref <308>: DATABASE ACCESSION NUMBER: NCBI ACCESSION: NZ_KV794470.1
  ref <309>: DATABASE ENTRY DATE: 2019-04-01
  ref <313>: RELEVANT RESIDUES IN SEQ ID NO: (1)..(1552)
ttaatgagagtttgatcctggctcaggacgaacgctggcggcgtgcctaatacatgcaagtagaacgctgaaggaggagcttgcttctccggatgagttgcgaacgggtgagtaacgcgtaggtaacctgcctggtagcgggggataactattggaaacgatagctaataccgcataagagtagatgttgcatgacatttacttaaaaggtgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaagga

SEQ ID NO: 9258 - DNA, 1557 bp, Streptococcus sp. HMSC077F03
  ref <308>: DATABASE ACCESSION NUMBER: NCBI ACCESSION: NZ_KV808746.1
  ref <309>: DATABASE ENTRY DATE: 2019-04-01
  ref <313>: RELEVANT RESIDUES IN SEQ ID NO: (1)..(1557)
ttttaatgagagtttgatcctggctcaggacgaacgctggcggcgtgcctaatacatgcaagtagaacgctgaagagaggagcttgctcttcttggatgagttgcgaacgggtgagtaacgcgtaggtaacctgcctggtagcgggggataactattggaaacgatagctaataccgcataatagtagatgttgcatgacatttgcttaaaaggtgcaattgcatcactaccagatggacctgcgttgtattagctagttggtggggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9259 - DNA, 1555 bp, Streptococcus sp. HMSC078D02; identical to SEQ ID NO: 9071
  ref <308>: DATABASE ACCESSION NUMBER: NCBI ACCESSION: NZ_KV813242.1
  ref <309>: DATABASE ENTRY DATE: 2019-04-01
  ref <313>: RELEVANT RESIDUES IN SEQ ID NO: (1)..(1555)

SEQ ID NO: 9260 - DNA, 1555 bp, Streptococcus sp. HMSC078D09
  ref <308>: DATABASE ACCESSION NUMBER: NCBI ACCESSION: NZ_KV813656.1
  ref <309>: DATABASE ENTRY DATE: 2019-04-01
  ref <313>: RELEVANT RESIDUES IN SEQ ID NO: (1)..(1555)
ttaatgagagtttgatcctggctcaggatgaacgctggcggcgtgcctaatacatgcaagtagaacgctgaagcttggtgcttgcaccgagcggatgagttgcgaacgggtgagtaacgcgtaggtaacctgcctcttagcgggggataactattggaaacgatagctaataccgcataaaagtcgatatcgcatgatattgatttgaaaggtgcaaatgcatcactaagagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgagtgtgagagtggaaagttcacactgtgacggtaacttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcgagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctcctttctaaggaa

SEQ ID NO: 9261 - DNA, 1555 bp, Streptococcus sp. HMSC078E03
  ref <308>: DATABASE ACCESSION NUMBER: NCBI ACCESSION: NZ_KV835744.1
  ref <309>: DATABASE ENTRY DATE: 2019-04-01
  ref <313>: RELEVANT RESIDUES IN SEQ ID NO: (1)..(1555)
ttaatgagagtttgatcctggctcaggacgaacgctggcggcgtgcctaatacatgcaagtagaacgctgatgtttggtgtttacactagactgatgagttgcgaacgggtgagtaacgcgtaggtaacctgcctcatagcgggggataactattggaaacgatagctaataccgcataagagtaattaacacatgttagttatttaaaaggagcaattgcttcactgtgagatggacctgcgttgtattagctagttggtgaggtaaaggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgttagagaagaacgttggtaggagtggaaaatctaccaagtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggcttaaccattgtacgctttggaaactggaggacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccttctgaccggcctagagataggctttctcttcggagcagaagtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9262 - DNA, 1555 bp, Streptococcus sp. HMSC078E08; identical to SEQ ID NO: 9071
  ref <308>: DATABASE ACCESSION NUMBER: NCBI ACCESSION: NZ_KV835780.1
  ref <309>: DATABASE ENTRY DATE: 2019-04-01
  ref <313>: RELEVANT RESIDUES IN SEQ ID NO: (1)..(1555)

SEQ ID NO: 9263 - DNA, 1555 bp, Streptococcus sp. HMSC078H03; identical to SEQ ID NO: 9136
  ref <308>: DATABASE ACCESSION NUMBER: NCBI ACCESSION: NZ_KV794084.1
  ref <309>: DATABASE ENTRY DATE: 2019-04-01
  ref <313>: RELEVANT RESIDUES IN SEQ ID NO: (1)..(1555)

SEQ ID NO: 9264 - DNA, 1435 bp, Streptococcus sp. HMSC078H12
  ref <308>: DATABASE ACCESSION NUMBER: NCBI ACCESSION: NZ_KV817309.1
  ref <309>: DATABASE ENTRY DATE: 2019-04-01
  ref <313>: RELEVANT RESIDUES IN SEQ ID NO: (1)..(1435)
ttaatgagagtttgatcctggctcaggacgaacgctggcggcgtgcctaatacatgcaagtagaacgctgaagagaggagcttgctcttcttggatgagttgcgaacgggtgagtaacgcgtaggtaacctgccttgtagcgggggataactattggaaacgatagctaataccgcataacaatggatgacacatgtcatttatttgaaaggggcaattgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacc

SEQ ID NO: 9265 - DNA, 1562 bp, Streptococcus sp. HMSC10A01
  ref <308>: DATABASE ACCESSION NUMBER: NCBI ACCESSION: NZ_KV790968.1
  ref <309>: DATABASE ENTRY DATE: 2019-04-01
  ref <313>: RELEVANT RESIDUES IN SEQ ID NO: (1)..(1562)
aatgagagtttgatcctggctcaggacgaacgctggcggcgtgcctaatacatgcaagtagaacgcacagtttataccgtagcttgctacaccatagactgtgagttgcgaacgggtgagtaacgcgtaggtaacctgcctggtagcgggggataactattggaaacgatagctaataccgcataatattaattattgcatgataattgattgaaaggtgcaattgcaccactaccagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtaagagaagaacgggtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9266 - DNA, 819 bp, Streptococcus sp. HMSC10E12
  ref <308>: DATABASE ACCESSION NUMBER: NCBI ACCESSION: NZ_KV791130.1
  ref <309>: DATABASE ENTRY DATE: 2019-04-01
  ref <313>: RELEVANT RESIDUES IN SEQ ID NO: (1)..(819)
ttaatgagagtttgatcctggctcaggacgaacgctggcggcgtgcctaatacatgcaagtagaacgctgaagagaggagcttgctcttcttggatgagttgcgaacgggtgagtaacgcgtaggtaacctgccttgtagcgggggataactattggaaacgatagctaataccgcataacaatggatgacacatgtcatttatttgaaaggggcaattgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgta

SEQ ID NO: 9267 - DNA, 1555 bp, Streptococcus sp. HMSC11C05; identical to SEQ ID NO: 9071
  ref <308>: DATABASE ACCESSION NUMBER: NCBI ACCESSION: NZ_KV791633.1
  ref <309>: DATABASE ENTRY DATE: 2019-04-01
  ref <313>: RELEVANT RESIDUES IN SEQ ID NO: (1)..(1555)

SEQ ID NO: 9268 - DNA, 1552 bp, Streptococcus sp. HMSC34B10; identical to SEQ ID NO: 9123
  ref <308>: DATABASE ACCESSION NUMBER: NCBI ACCESSION: NZ_KV841547.1
  ref <309>: DATABASE ENTRY DATE: 2019-04-01
  ref <313>: RELEVANT RESIDUES IN SEQ ID NO: (1)..(1552)

SEQ ID NO: 9269 - DNA, 1560 bp, Streptococcus sp. HMSC36C04; identical to SEQ ID NO: 9203
  ref <308>: DATABASE ACCESSION NUMBER: NCBI ACCESSION: NZ_KV841568.1
  ref <309>: DATABASE ENTRY DATE: 2019-04-01
  ref <313>: RELEVANT RESIDUES IN SEQ ID NO: (1)..(1560)

SEQ ID NO: 9270 - DNA, 1552 bp, Streptococcus sp. HPH0090
  ref <308>: DATABASE ACCESSION NUMBER: NCBI ACCESSION: NZ_KE150464.1
  ref <309>: DATABASE ENTRY DATE: 2019-04-01
  ref <313>: RELEVANT RESIDUES IN SEQ ID NO: (1)..(1552)
ttaatgagagtttgatcctggctcaggatgaacgctggcggcgtgcctaatacatgcaagtagaacgctgaaggaggagcttgctcttctggatgagttgcgaacgggtgagtaacgcgtaggtaacctgcctggtagcgggggataactattggaaacgatagctaataccgcatgacaacagttattgcatgataactgtttaaaaggggcaattgctccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctcctttctaagga

SEQ ID NO: 9271 - DNA, 1555 bp, Streptococcus sp. I-G2
  ref <308>: DATABASE ACCESSION NUMBER: NCBI ACCESSION: NC_022584.1
  ref <309>: DATABASE ENTRY DATE: 2019-04-01
  ref <313>: RELEVANT RESIDUES IN SEQ ID NO: (1)..(1555)
ttaatgagagtttgatcctggctcaggatgaacgctggcggcgtgcctaatacatgcaagtagaacgctgaagcttggtgcttgcaccgagcggatgagttgcgaacgggtgagtaacgcgtaggtaacctgcctggtagcgggggataactattggaaacgatagctaataccgcataacagtagatattgcatgatatctgcttgaaagatgcaattgcatcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9272 - DNA, 1555 bp, Streptococcus sp. JS71
  ref <308>: DATABASE ACCESSION NUMBER: NCBI ACCESSION: NZ_CP032620.1
  ref <309>: DATABASE ENTRY DATE: 2019-04-01
  ref <313>: RELEVANT RESIDUES IN SEQ ID NO: (1)..(1555)
ttaatgagagtttgatcctggctcaggatgaacgctggcggcgtgcctaatacatgcaagtagaacgctgaaggaaggagcttgctctttccagatgagttgcgaacgggtgagtaacgcgtaggtaacctgcctggtagcgggggataactattggaaacgatagctaataccgcataacaacagatgttgcatgacagctgtttgaaaggggcaattgctccactaccagatggacctgcgttgtattagctagttggtgaggtaacggcttaccaaggcgacgatacatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9273 - DNA, 1563 bp, Streptococcus sp. KCOM 2412
  ref <308>: DATABASE ACCESSION NUMBER: NCBI ACCESSION: NZ_CP034543.1
  ref <309>: DATABASE ENTRY DATE: 2019-04-01
  ref <313>: RELEVANT RESIDUES IN SEQ ID NO: (1)..(1563)
ttaatgagagtttgatcctggctcaggacgaacgctggcggcgtgcctaatacatgcaagtggaacgcacgaggtacaccgtagtttactacaccgtactttgtgagtcgcgaacgggtgagtaacgcgtaggtaacctaccttttagcgggggataactattggaaacgatagctaataccgcataagatatcttactgcatagtaagatattaaaagatgcaattgcatcactaagagatggacctgcgttgtattagctagtaggtgaggtaacggctcacctaggcaacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttaaggaagaacgagtgtgagaatggaaagttcatgctgtgacggtacttaaccagaaagggacggctaactacgtgccagcagccgcggtaatacgtaggtcccgagcgttgtccggatttattgggcgtaaagcgagcgcaggcggttggaaaagtctgaagtgaaaggcagtggctcaaccattgtaggctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccggtgcccgtcctagagataggattttgcttcggcacaccggtgacaggtggtgcatggttgtcgtcagctcgtgtcgtgagatgttgggttaagtcccgcaacgagcgcaacccttattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctctgaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggaa

SEQ ID NO: 9274 - DNA, 1552 bp, Streptococcus sp. KR
  ref <308>: DATABASE ACCESSION NUMBER: NCBI ACCESSION: NZ_NGVM01000037.1
  ref <309>: DATABASE ENTRY DATE: 2019-04-01
  ref <313>: RELEVANT RESIDUES IN SEQ ID NO: (1)..(1552)
ttaatgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataagagtagatgttgcataacatttgcttaaaaggtgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaagga

SEQ ID NO: 9275 - DNA, 1555 bp, Streptococcus sp. LQJ-218
  ref <308>: DATABASE ACCESSION NUMBER: NCBI ACCESSION: NZ_QQRU01000015.1
  ref <309>: DATABASE ENTRY DATE: 2019-04-01
  ref <313>: RELEVANT RESIDUES IN SEQ ID NO: (1)..(1555)
ttaatgagagtttgatcctggctcaggacgaacgctggcggcgtgcctaatacatgcaagtagaacgctgaaggaaggagcttgctctttccggatgagttgcgaacgggtgagtaacgcgtaggtaacctgcctggtagtgggggataactattggaaacgatagctaataccgcataatagtagatgttgcatgacatttgcttaaaaggtgcaattgcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccttattgttagttgccatcatttagttgggcactctaacgagactgccggtaataaaccggaggaaggtggggatgacgtcaaatcagcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9276 - DNA, 1553 bp, Streptococcus sp. M143
  ref <308>: DATABASE ACCESSION NUMBER: NCBI ACCESSION: NZ_GG730101.1
  ref <309>: DATABASE ENTRY DATE: 2019-04-01
  ref <313>: RELEVANT RESIDUES IN SEQ ID NO: (1)..(1553)
ttaatgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataatagcagttattgcatgataactgtttgaaaggtgcaattgcaccactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9277 - DNA, 1552 bp, Streptococcus sp. M334
  ref <308>: DATABASE ACCESSION NUMBER: NCBI ACCESSION: NZ_GL732500.1
  ref <309>: DATABASE ENTRY DATE: 2019-04-01
  ref <313>: RELEVANT RESIDUES IN SEQ ID NO: (1)..(1552)
ttaatgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataagagtagatgttgcatgacatttgcttaaaaggtgcaattgcatcactaccagatggacctgcgttgtattagctagttggtggggtaacggcttaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggtaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaagga

SEQ ID NO: 9278 - DNA, 1554 bp, Streptococcus sp. NLAE-zl-C503
  ref <308>: DATABASE ACCESSION NUMBER: NCBI ACCESSION: NZ_FNJT01000014.1
  ref <309>: DATABASE ENTRY DATE: 2019-04-01
  ref <313>: RELEVANT RESIDUES IN SEQ ID NO: (1)..(1554)
ttaatgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataatattgactattgcatgatagtcaattaaaaggtgcaattgcatcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9279 - DNA, 1552 bp, Streptococcus sp. NM; identical to SEQ ID NO: 9212
  ref <308>: DATABASE ACCESSION NUMBER: NCBI ACCESSION: NZ_QUOS01000001.1
  ref <309>: DATABASE ENTRY DATE: 2019-04-01
  ref <313>: RELEVANT RESIDUES IN SEQ ID NO: (1)..(1552)

SEQ ID NO: 9280 - DNA, 1553 bp, Streptococcus sp. NPS 308
  ref <308>: DATABASE ACCESSION NUMBER: NCBI ACCESSION: NZ_AP017652.1
  ref <309>: DATABASE ENTRY DATE: 2019-04-01
  ref <313>: RELEVANT RESIDUES IN SEQ ID NO: (1)..(1553)
ttaatgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataaaattgattattgcatgatagtcaattaaaaggtgcaattgcatcactaccagatggacctgcgttgtattagctagttggtggggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9281 - DNA, 1560 bp, Streptococcus sp. OBRC6; identical to SEQ ID NO: 9151
  ref <308>: DATABASE ACCESSION NUMBER: NCBI ACCESSION: NZ_JACR01000021.1
  ref <309>: DATABASE ENTRY DATE: 2019-04-01
  ref <313>: RELEVANT RESIDUES IN SEQ ID NO: (1)..(1560)

SEQ ID NO: 9282 - DNA, 1552 bp, Streptococcus sp. OH4692 COT-348
  ref <308>: DATABASE ACCESSION NUMBER: NCBI ACCESSION: NZ_RQZB01000025.1
  ref <309>: DATABASE ENTRY DATE: 2019-04-01
  ref <313>: RELEVANT RESIDUES IN SEQ ID NO: (1)..(1552)
ttaatgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataagagtagatgttgcatgacatttacttaaaaggtgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgacctctctagagatagagatttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaagga

SEQ ID NO: 9283 - DNA, 1552 bp, Streptococcus sp. SK643
  ref <308>: DATABASE ACCESSION NUMBER: NCBI ACCESSION: NZ_AJMM01000011.1
  ref <309>: DATABASE ENTRY DATE: 2019-04-01
  ref <313>: RELEVANT RESIDUES IN SEQ ID NO: (1)..(1552)
ttaatgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataacattgactattgcatgatagtcagttaaaaggtgcaattgcaccactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaagga

SEQ ID NO: 9284 - DNA, 1555 bp, Streptococcus sp. SR1; identical to SEQ ID NO: 9092
  ref <308>: DATABASE ACCESSION NUMBER: NCBI ACCESSION: NZ_JATR01000023.1
  ref <309>: DATABASE ENTRY DATE: 2019-04-01
  ref <313>: RELEVANT RESIDUES IN SEQ ID NO: (1)..(1555)

SEQ ID NO: 9285 - DNA, 1555 bp, Streptococcus sp. SR4; identical to SEQ ID NO: 9136
  ref <308>: DATABASE ACCESSION NUMBER: NCBI ACCESSION: NZ_AZYW01000057.1
  ref <309>: DATABASE ENTRY DATE: 2019-04-01
  ref <313>: RELEVANT RESIDUES IN SEQ ID NO: (1)..(1555)

SEQ ID NO: 9286 - DNA, 1552 bp, Streptococcus sp. UMB0029
  ref <308>: DATABASE ACCESSION NUMBER: NCBI ACCESSION: NZ_PNGD01000027.1
  ref <309>: DATABASE ENTRY DATE: 2019-04-01
  ref <313>: RELEVANT RESIDUES IN SEQ ID NO: (1)..(1552)
ttaatgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataatagtagatgttgcatgacatttgcttaaaaggtgcaattgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcattgagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaagga

SEQ ID NO: 9287 - DNA, 1558 bp, Streptococcus sp. UMB1385
  ref <308>: DATABASE ACCESSION NUMBER: NCBI ACCESSION: NZ_PNGU01000024.1
  ref <309>: DATABASE ENTRY DATE: 2019-04-01
  ref <313>: RELEVANT RESIDUES IN SEQ ID NO: (1)..(1558)
gagagtttgatcctggctcaggacgaacgctggcggcgtgcctaatacatgcaagtcgagcgaagtttttctggtgcttgcaccggaaaaacttagcggcgaacgggtgagtaacacgtaaagaacctgcctcatagactgggacaactattggaaacgatagctaataccggataacagcattaactgcatggttgatgtttaaaagttggttttgctaacactatgagatggctttgcggtgcattagctagttggtggggtaaaggcctaccaaggcgacgatgcatagccgacctgagagggtgaacggccacactgggactgagacacggcccagactcctacgggaggcagcagtagggaatcttccgcaatgggcgaaagcctgacggagcaacgccgcgtgagtgaagaaggatttcggttcgtaaagctctgttgttagggaagaatgattgtgtagtaactatacatagtagagacggtacctaaccagaaagccacggctaactacgtgccagcagccgcggtaatacgtaggtggcaagcgttgtccggaattattgggcgtaaagcgcgcgcaggtggtttaataagtctgatgtgaaagcccacggctcaaccgtggagggtcattggaaactgttaaacttgagtgcaggagagaaaagtggaattcctagtgtagcggtgaaatgcgtagagattaggaggaacaccagtggcgaaggcggctttttggcctgtaactgacactgaggcgcgaaagcgtggggagcaaacaggattagataccctggtagtccacgccgtaaacgatgagtgctaagtgttggtctcataagagatcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaagtcttgacatactgtgaggacacaagagattgtgttgttctgacctttggttagacacagatacaggtggtgcatggttgtcgtcagctcgtgtcgtgagatgttgggttaagtcccgcaacgagcgcaacccttatatctagttgccagcagtaagatggggactctagatagactgccagtgataaactggaggaaggtggggatgacgtcaaatcatcatgccccttatgacttgggctacacacgtgctacaatggataggaacaaagagaagcgagctcgcgagagtaagcaaacctcacaaaactattctcagttcggattgtagtctgcaactcgactacatgaagctggaatcgctagtaatcgcgaatcagaatgtcgcggtgaatacgttcccgggtcttgtacacaccgcccgtcacaccacgagagtttgtaacacccgaagacggtggcctaaccttttaggagggagccggtcacggtgggacagatgattggggtgaagtcgtaacaaggtagccgtatcggaaggtgcggctggatcacctcctttctaagga

SEQ ID NO: 9288 - DNA, 1566 bp, Streptococcus sp. X13SY08
  ref <308>: DATABASE ACCESSION NUMBER: NCBI ACCESSION: NZ_LFYO02000005.1
  ref <309>: DATABASE ENTRY DATE: 2019-04-01
  ref <313>: RELEVANT RESIDUES IN SEQ ID NO: (1)..(1566)
ttaatgagagtttgatcctggctcaggacgaacgctggcggcgtgcctaatacatgcaagtggaacgcttttttctcaccgagtgcttgcactcaccgagaggaaagagtcgcgaacgggtgagtaacgcgtaggtaacctacctcttagcgggggataactgttggaaacgatagctaataccgcataacaatgttgtacacatgtacagtatttgaaaggagcaattgcttcactaagagatggacctgcgttgtattagctagttggtgaggtaacggctcaccaaggcgtcgatacatagccgacctgagagggtgatcggccacactgggactgagacacggcccagactcctacgggaggcagcagtagggaatcttcggcaatgggggggaccctgaccgagcaacgccgcgtgagtgaagaaggttttcggatcgtaaagctctgttgtaagagaagaacgggagtaagagtggaaagtttactctgtgacggtatcttaccagaaagggacggctaactacgtgccagcagccgcggtaatacgtaggtcccgagcgttgtccggatttattgggcgtaaagcgagcgcaggtggttctttaagtctgaagtgaaaggcagtggctcaaccattgtgtgctttggaaactggagaacttgagtgcagaaggggagagtggaattccatgtgtagcggtgaaatgcgtagatatatggaggaacaccggtggcgaaagcggctctctggtctgtaactgacactgaggctcgaaagcgttgggagggaataggattagataccctggtagtccacgccgtaaacgatgagtgctaggtgttgggtcctttccgggactcagtgccgcagctaacgcattaagcactccgcctggggagtacggccgcaaggttgaaactcaaaggaattgacgggggcccgcacaagcggtggagcatgtggtttaattcgaagcaacgcgaagaaccttaccaggtcttgacatcccgatgtccgctctagagatagagttttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggtcggtacaacgagtcgcaagctggtgacagtgagctaatctcttaaagccgatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgagggaaccttttaggagccagccgcctaaggtgggatagatgattggggtgaagtcgtaacaaggtagccgtatcggaaggtgcggctggatcacctcctttctaaggaa

SEQ ID NO: 9289 - DNA, 1561 bp, Streptococcus sp. Z15
  ref <308>: DATABASE ACCESSION NUMBER: NCBI ACCESSION: NZ_CP031733.1
  ref <309>: DATABASE ENTRY DATE: 2019-04-01
  ref <313>: RELEVANT RESIDUES IN SEQ ID NO: (1)..(1561)
atgagagtttgatcctggctcaggacgaacgctggcggcgtgcctaatacatgcaagtggaacgcttctttcttaccgagtgcttgcactcacaaggaagaggagtcgcgaacgggtgagtaacgcgtaggtaacctgtctttaagagggggataactattggaaacgatagctaataccgcatatttttctcagacgcctgtttgagggaagaaaggggcaagagctccgcttagaggtggacctgcgttgtattagctagttggtagggtaaaggcctaccaaggcgacgatacatagccggcctgagagggtgaacggccacactgggactgagacacggcccagactcctacgggaggcagcagtagggaatcttcggcaatggggggaaccctgaccgagcaacgccgcgtgagtgaagaaggaattcgtttcgtaaagctctgttgtaagtgaagaacgtgcttgagagtggaaagttcaggcagtgacggtaacttacgaggaagggacggctaactacgtgccagcagccgcggtaatacgtaggtcccgagcgttgtccggaattattgggcgtaaagggagcgcaggcggttttgtaagtcagaagtcaaaggcattggcttaaccaatgtatgctattgaaactgcaggacttgagtgcagaaggggagagtggaattccatgtgtagcggtgaaatgcgtagatatatggaggaacaccggcggcgaaagcggctctctggtctgttactgacgctgaggctcgaaagcgtggggagcaaacaggattagataccctggtagtccacgccgtaaacgctgagtgctaggtgttaggccctatccggggcttagtgccggagccaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatccctctgctaggtctagagatagacttttccttcgggacagaggagacaggtggtgcatggttgtcgtcagctcgtgtcgtgagatgttgggttaagtcccgcaacgagcgcaacccttatggttagttgccatcattcagttgggccctctagccagactgccggtaataaaccggaggaaggtggggatgacgtcaaatcatcatgccccttatgacctgggctacacacgtgctacaatggctggtacaacgagttgcgagtcggtgacggcaagctaatctctgaaagccagtctcagttcggattggaggctgcaactcgcctccatgaagtcggaatcgctagtaatcgcggatcagcacgccgcggtgaatacgttcccgggccttgtacacaccgcccgtcacaccacgagagtttgtaacacccgaagtcggtgaggtaacctaatggagccagccgccgaaggtgggatagatgattggggtgaagtcgtaacaaggtagccgtatcggaaggtgcggctggatcacctcctttctaaggaa

SEQ ID NO: 9290 - DNA, 1561 bp, Streptococcus sp. Z1 2018; identical to SEQ ID NO: 9289
  ref <308>: DATABASE ACCESSION NUMBER: NCBI ACCESSION: NZ_QVQZ01000054.1
  ref <309>: DATABASE ENTRY DATE: 2019-04-01
  ref <313>: RELEVANT RESIDUES IN SEQ ID NO: (1)..(1561)

SEQ ID NO: 9291 - DNA, 1561 bp, Streptococcus sp. Z2; identical to SEQ ID NO: 9289
  ref <308>: DATABASE ACCESSION NUMBER: NCBI ACCESSION: NZ_QVQY01000057.1
  ref <309>: DATABASE ENTRY DATE: 2019-04-01
  ref <313>: RELEVANT RESIDUES IN SEQ ID NO: (1)..(1561)

SEQ ID NO: 9292 - DNA, 1555 bp, Streptococcus sp. bf 0095
  ref <308>: DATABASE ACCESSION NUMBER: NCBI ACCESSION: NZ_RCYU01000006.1
  ref <309>: DATABASE ENTRY DATE: 2019-04-01
  ref <313>: RELEVANT RESIDUES IN SEQ ID NO: (1)..(1555)
ttaatgagagtttgatcctggctcaggatgaacgctggcggcgtgcctaatacatgcaagtagaacgctgaaggaaggagcttgctctttccggatgagttgcgaacgggtgagtaacgcgtaggtaacctgcctggtagcgggggataactattggaaacgatagctaataccgcataacagtagatattgcatgatatctgcttgaaaggtgcaattgcaccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9293 - DNA, 1557 bp, Streptococcus sp. caviae
  ref <308>: DATABASE ACCESSION NUMBER: NCBI ACCESSION: NZ_MOWR01000017.1
  ref <309>: DATABASE ENTRY DATE: 2019-04-01
  ref <313>: RELEVANT RESIDUES IN SEQ ID NO: (1)..(1557)
gagagtttgatcctggctcaggacgaacgctggcggcgtgcctaatacatgcaagtggaacgcacgattaaaccgtagcttgctacaccataatcgtgagtcgcgaacgggtgagtaacgcgtaggtaacctgcctattagcgggggataactattggaaacgatagctaataccgcataggagagatgatcgcatgatcatgtcttaaaagatacaactgtatcgctagtagatggacctgcgttgtattagctagttggtaaggtagtggcttaccaaggcaacgatacatagccgacctgagagggtgaccggccacactgggactgagacacggcccagactcctacgggaggcagcagtagggaatcttcggcaatggggggaaccctgaccgagcaacgccgcgtgagtgaagaaggttttcggatcgtaaagctctgttgtcagagacgaacgtatgtgagagtggaaagttcacatagtgacggtaactgaccagaaagggacggctaactacgtgccagcagccgcggtaatacgtaggtcccgagcgttgtccggatttattgggcgtaaagcgagcgcaggcggttttgtaagtctgaagtcaaaggcagtggcttaaccattgtgtgctttggaaactgcaggacttgagtgcagaaggggagagtggaattccatgtgtagcggtgaaatgcgtagatatatggaggaacaccggtggcgaaagcggctctctggtctgtgactgacgctgaggctcgaaagcgtgggtagcgaacaggattagataccctggtagtccacgccgtaaacgctgagtgctaggtgttaggccctttccggggcttagtgccgaagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgatgctattcttagagataagaagttacttcggtacattggagacaggtggtgcatggttgtcgtcagctcgtgtcgtgagatgttgggttaagtcccgcaacgagcgcaacccttattgttagttgccatcattaagttgggcactctagcgagactgccggtaataaaccggaggaaggtggggatgacgtcaaatcatcatgccccttatgacctgggctacacacgtgctacaatggtcggtacaacgagttgcgagccggtgacggcaagctaatctctgaaagccgatctcagttcggattggaggctgcaactcgcctccatgaagtcggaatcgctagtaatcgcggatcagcacgccgcggtgaatacgttcccgggccttgtacacaccgcccgtcacaccacgagagtttgtaacacccgaagtcggtgaggtaacctttaaggggccagccgcctaaggtgggatggatgattggggtgaagtcgtaacaaggtagccgtatcggaaggtgcggctggatcacctcctttctaaggaa

SEQ ID NO: 9294 - DNA, 1555 bp, Streptococcus sp. group B; identical to SEQ ID NO: 9071
  ref <308>: DATABASE ACCESSION NUMBER: NCBI ACCESSION: NZ_CP020432.1
  ref <309>: DATABASE ENTRY DATE: 2019-04-01
  ref <313>: RELEVANT RESIDUES IN SEQ ID NO: (1)..(1555)

SEQ ID NO: 9295 - DNA, 1552 bp, Streptococcus sp. oral taxon 056
  ref <308>: DATABASE ACCESSION NUMBER: NCBI ACCESSION: NZ_AFQU01000001.1
  ref <309>: DATABASE ENTRY DATE: 2019-04-01
  ref <313>: RELEVANT RESIDUES IN SEQ ID NO: (1)..(1552)
aatgagagtttgatcctggctcaggacgaacgctggcggcgtgcctaatacatgcaagtagaacgctgaaggaggagcttgctcttctggaagagttgcgaacgggtgagtaacgcgtaggtaacctgcctggtagcgggggataactattggaaacgatagctaataccgcataagattgaaaatcgcatgataattgattaaaagatgcaattgcatcactaccagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttaggccctttccggggcttagtgccggagctaacgcattaagcactccgcctggggagtacgaccgcaaggttgaactcgaaaggaattgactggggcccacacaagcggtggatcatgtggttttaattcaagcaacgacgaagaccttaccagggcctgacctcccgatgcccgctcaaaatgaaaaagttttacttccgtaacaccgatgaaaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctggggctacacacgtgctacaatggctggtacaacgagtcgcaagtcggtgacgacaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaagggatagatgattggggtgaagtcgtaacaaggtagccgtatcggaaggtgcggctggatcacctcctttctaaggaa

SEQ ID NO: 9296 - DNA, 1552 bp, Streptococcus sp. oral taxon 058
  ref <308>: DATABASE ACCESSION NUMBER: NCBI ACCESSION: NZ_JH378877.1
  ref <309>: DATABASE ENTRY DATE: 2019-04-01
  ref <313>: RELEVANT RESIDUES IN SEQ ID NO: (1)..(1552)
ttaatgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataatattgattattgcatgatagtcaattaaaaggtgcaattgcaccactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctcctttctaagga

SEQ ID NO: 9297 - DNA, 1555 bp, Streptococcus sp. oral taxon 064
  ref <308>: DATABASE ACCESSION NUMBER: NCBI ACCESSION: NZ_CP016207.1
  ref <309>: DATABASE ENTRY DATE: 2019-04-01
  ref <313>: RELEVANT RESIDUES IN SEQ ID NO: (1)..(1555)
ttaatgagagtttgatcctggctcaggacgaacgctggcggcgtgcctaatacatgcaagtagaacgctgaagagaggagcttgctcttcttggatgagttgcgaacgggtgagtaacgcgtaggtaacctgcctggtagcgggggataactattggaaacgatagctaataccgcataagagtagatgttgcatgacatttgcttaaaaggtgcaattgcatcactaccagatggacctgcgttgtattagctagttggtgaggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9298 - DNA, 1555 bp, Streptococcus sp. oral taxon 071
  ref <308>: DATABASE ACCESSION NUMBER: NCBI ACCESSION: NZ_GL397255.1
  ref <309>: DATABASE ENTRY DATE: 2019-04-01
  ref <313>: RELEVANT RESIDUES IN SEQ ID NO: (1)..(1555)
ttaatgagagtttgatcctggctcaggacgaacgctggcggcgtgcctaatacatgcaagtagaacgctgaagagaggagcttgctcttcttggatgagttgcgaacgggtgagtaacgcgtaggtaacctgcctggtagcgggggataactattggaaacgatagctaataccgcataaaatggattatcgcatgatgattcattgaaaggtgcaaatgcatcactaccagatggacctgcgttgtattagctagttggtggggtaacggctcaccaaggcaacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgatcgctctagagatagagctttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgtggctggatcacctcctttctaagga

SEQ ID NO: 9299 - DNA, 1553 bp, Streptococcus sp. oral taxon 431
  ref <308>: DATABASE ACCESSION NUMBER: NCBI ACCESSION: NZ_CP014264.1
  ref <309>: DATABASE ENTRY DATE: 2019-04-01
  ref <313>: RELEVANT RESIDUES IN SEQ ID NO: (1)..(1553)
ttaatgagagtttgatcctggctcaggacgaacgctggcggcgtgcctaatacatgcaagtagaacgctgaaggaggagcttgcttctccggatgagttgcgaacgggtgagtaacgcgtaggtaacctgcctggtagcgggggataactattggaaacgatagctaataccgcataacagtagatattgcatgatatctgcttaaaaggtgcaattgcatcactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9300 - DNA, 1556 bp, Streptococcus suis
  ref <308>: DATABASE ACCESSION NUMBER: NCBI ACCESSION: NZ_LS483418.1
  ref <309>: DATABASE ENTRY DATE: 2019-04-01
  ref <313>: RELEVANT RESIDUES IN SEQ ID NO: (1)..(1556)
tttatgagagtttgatcctggctcaggacgaacgctggcggcgtgcctaatacatgcaagtagaacgctgaagtctggtgcttgcactagacggatgagttgcgaacgggtgagtaacgcgtaggtaacctgcctcatagcgggggataactattggaaacgatagctaataccgcataacagtatttaccgcatggtagatatttgaaaggagcaattgcttcactatgagatggacctgcgttgtattagctagttggtgaggtaacggctcaccaaggcttcgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaactgtgagaagagtggaaagtttctcacttgacggtatcttaccagaaagggacggctaactacgtgccagcagccgcggtaatacgtaggtcccgagcgttgtccggatttattgggcgtaaagcgagcgcaggcggtttgataagtctgaagtaaaaggctgtggcttaaccatagtacgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgaccgccctagagatagggtttctcttcggagcatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9301 - DNA, 1555 bp, Streptococcus thermophilus
  ref <308>: DATABASE ACCESSION NUMBER: NCBI ACCESSION: NZ_LS974444.1
  ref <309>: DATABASE ENTRY DATE: 2019-04-01
  ref <313>: RELEVANT RESIDUES IN SEQ ID NO: (1)..(1555)
ttaatgagagtttgatcctggctcaggacgaacgctggcggcgtgcctaatacatgcaagtagaacgctgaagagaggagcttgctcttcttggatgagttgcgaacgggtgagtaacgcgtaggtaacctgccttgtagcgggggataactattggaaacgatagctaataccgcataacaatggatgacacatgtcatttatttgaaaggggcaattgttccactacaagatggacctgcgttgtattagctagtaggtgaggtaatggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgggtgtgagagtggaaagttcacactatgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcgagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctcctttctaaggaa

SEQ ID NO: 9302 - DNA, 1566 bp, Streptococcus thoraltensis
  ref <308>: DATABASE ACCESSION NUMBER: NCBI ACCESSION: NZ_KB904624.1
  ref <309>: DATABASE ENTRY DATE: 2019-04-01
  ref <313>: RELEVANT RESIDUES IN SEQ ID NO: (1)..(1566)
ttaatgagagtttgatcctggctcaggacgaacgctggcggcgtgcctaatacatgcaagtggaacgcatttataactaccgtagcttgctacaattggtataaatgagtcgcgaacgggtgagtaacgcgtaggtaacctacctttaagcgggggataactattggaaacgatagctaataccgcataaaaggagctaacccatgttagctttttaaaaggtgcaacagcatcacttaaagatggacctgcgttgtattagctagttggtaaggtaacggcttaccaaggcttcgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttataagcgaagaataggagtaagagtggaaagtttactctatgacggtagcttatcagaaagggacggctaactacgtgccagcagccgcggtaatacgtaggtcccgagcgttgtccggatttattgggcgtaaagcgagcgcaggtggtttaataagtctgaagttaaaggcagtggctcaaccattgtacgctttggaaactgttaaacttgagtgcagaaggggagagtggaattccatgtgtagcggtgaaatgcgtagatatatggaggaacaccggtggcgaaagcggctctctggtctgtaactgacactgaggctcgaaagcgtgggtagcgaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccggtgccggttctagagatagaacttttcttaggaacactggagacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggtcggtacaacgagttgcgagctggtgacagtaagctaatctcttaaagccgatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9303 - DNA, 1552 bp, Streptococcus timonensis
  ref <308>: DATABASE ACCESSION NUMBER: NCBI ACCESSION: NZ_FMIX01000004.1
  ref <309>: DATABASE ENTRY DATE: 2019-04-01
  ref <313>: RELEVANT RESIDUES IN SEQ ID NO: (1)..(1552)
ttaatgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataatattgattattgcatgatagtcaattaaaaggtgcaattgcaccactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgccgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagttttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccatttggagccagccgcctaaggtgggatagatgattggggtgaagtcgtaacaaggtagccgtatcggaaggtgcggctggatcacctcctttctaagga

SEQ ID NO: 9304 - DNA, 1562 bp, Streptococcus troglodytae
  ref <308>: DATABASE ACCESSION NUMBER: NCBI ACCESSION: NZ_AP014612.1
  ref <309>: DATABASE ENTRY DATE: 2019-04-01
  ref <313>: RELEVANT RESIDUES IN SEQ ID NO: (1)..(1562)
taatgagagtttgatcctggctcaggacgaacgctggcggcgtgcctaatacatgcaagtgggacgcactgatttcacgggagcttgctccacgaggtcagtgagtcgcgaacgggtgagtaacgcgtaggtaacctgcctactagcgggggataactattggaaacgatagctaataccgcatgctagcttttagcgcatgctaggagcttaaaagatgcaactgcatcactagtagatggacctgcgttgtattagctagttggtaaggtaagagcttaccaaggcgacgatacatagccgacctgagagggtgaacggccacactgggactgagacacggcccagactcctacgggaggcagcagtagggaatcttcggcaatggacgaaagtctgaccgagcaacgccgcgtgagtgaagaaggttttcggatcgtaaagctctgttgtaagcgaagaacgggtgtaagagtggaaagcttagactgtgacggtagcttaccagaaagggacggctaactacgtgccagcagccgcggtaatacgtaggtcccgagcgttgtccggatttattgggcgtaaagggagcgcaggcggttaggaaagtctggagtaaaaggctatggctcaaccatagtgtgctctggaaactgtctgacttgagtgcagaaggggagagtggaattccatgtgtagcggtgaaatgcgtagatatatggaggaacaccagtggcgaaagcggctctctggtctgtcactgacgctgaggctcgaaagcgtgggtagcgaacaggattagataccctggtagtccacgccgtaaacgctgagtgctaggtgttaggccctttccggggcttagtgccggagctaacgcaataagcactccgcctggggagtacgaccgcaaggttgaaactcaaaggaattgacgggggcccgcacaagcggtggagcatgtggtttaattcgaagcaacgcgaagaaccttaccaggtcttgacatcccgatgttattcttagagataagaagttacttcggtacatcggagacaggtggtgcatggttgtcgtcagctcgtgtcgtgagatgttgggttaagtcccgcaacgagcgcaacccttattgttagttgccatcattaagttgggcactctagcgagactgccggtaataaaccggaggaaggtggggatgacgtcaaatcatcatgccccttatgacctgggctacacacgtgctacaatggtcggtacaacgagttgcgagccggtgacggcaagctaatctctgaaagccgatctcagttcggattggaggctgcaactcgcctccatgaagtcggaatcgctagtaatcgcggatcagcacgccgcggtgaatacgttcccgggccttgtacacaccgcccgtcacaccacgagagtttgtaacacccgaagtcggtgaggtaaccgttaaggggccagccgcctaaggtgggatggatgattggggtgaagtcgtaacaaggtagccgtatcggaaggtgcggctggatcacctcctttctaaggaa

SEQ ID NO: 9305 - DNA, 1553 bp, Streptococcus uberis
  ref <308>: DATABASE ACCESSION NUMBER: NCBI ACCESSION: NZ_LS483408.1
  ref <309>: DATABASE ENTRY DATE: 2019-04-01
  ref <313>: RELEVANT RESIDUES IN SEQ ID NO: (1)..(1553)
aatgagagtttgatcctggctcaggacgaacgctggcggcgtgcctaatacatgcaagtagaacgctgaggactggtgcttgcactggtctaaggagttgcgaacgggtgagtaacgcgtaggtaacctacctcatagcgggggataactattggaaacgatagctaataccgcatgacaatagggtacacatgtaccctatttaaaaggggcaaatgcttcactatgagatggacctgcgttgtattagctagttggtaaggtaacggcttaccaaggcgacgatacatagccgacctgagagggtgatcggccacactgggactgagacacggcccagactcctacgggaggcagcagtagggaatcttcggcaatggggggaaccctgaccgagcaacgccgcgtgagtgaagaaggttttcggatcgtaaagctctgttgttagagaagaacggtaatgggagtggaaaatccattacgtgacggtaactaaccagaaagggacggctaactacgtgccagcagccgcggtaatacgtaggtcccgagcgttgtccggatttattgggcgtaaagcgagcgcaggcggtttgataagtctgaagttaaaggctgtggcttaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccggagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagctttacttcggtacatcggtgacaggtggtgcatggttgtcgtcagctcgtgtcgtgagatgttgggttaagtcccgcaacgagcgcaacccctattgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaacctattaggagccagccgcctaaggtgggatagatgattggggtgaagtcgtaacaaggtagccgtatcggaaggtgcggctggatcacctcctttctaagga

SEQ ID NO: 9306 - DNA, 1556 bp, Streptococcus urinalis
  ref <308>: DATABASE ACCESSION NUMBER: NCBI ACCESSION: NZ_LR134323.1
  ref <309>: DATABASE ENTRY DATE: 2019-04-01
  ref <313>: RELEVANT RESIDUES IN SEQ ID NO: (1)..(1556)
ttaatgagagtttgatcctggctcaggacgaacgctggcggcgtgcctaatacatgcaagtagaacgctgaggtcatgtgcttgcacaagaccaaggagttgcgaacgggtgagtaacgcgtaggtaacctgcctcatagcgggggataactattggaaacgatagctaataccgcatgagagtttttaacacatgttaggaacttaaaaggagcaactgcttcactatgagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgttagagaagaatggaagtaggagtggaaagtctacttcgtgacggtaactaaccagaaagggacggctaactacgtgccagcagccgcggtaatacgtaggtcccgagcgttgtccggatttattgggcgtaaagcgagcgcaggcggttctataagtctgaagttaaaggcagtggctcaaccattgttcgctttggaaactgtagaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttaggccctttccggggcttagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgcccgctctagagatagagttttacttcggtacatcggagacaggtggtgcatggttgtcgtcagctcgtgtcgtgagatgttgggttaagtcccgcaacgagcgcaacccctattgttagttgccatcattcagttgggcactctagcaagactgccggtaataaaccggaggaaggtggggatgacgtcaaatcatcatgccccttatgacctgggctacacacgtgctacaatggttggtacaacgagtcgcaagtcggtgacgacaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 9307 - DNA, 1563 bp, Streptococcus varani
  ref <308>: DATABASE ACCESSION NUMBER: NCBI ACCESSION: NZ_CTEN01000001.1
  ref <309>: DATABASE ENTRY DATE: 2019-04-01
  ref <313>: RELEVANT RESIDUES IN SEQ ID NO: (1)..(1563)
aatgagagtttgatcctggctcaggacgaacgctggcggcgtgcctaatacatgcaagtggaacgcaacttttctcccgtttcttcggaaacacctgagaagttgagtcgcgaacgggtgagtaacgcgtaggtaacctacctcttagcgggggataactattggaaacgatagctaataccgcataacagtgtttaacacatgttaaacatttgaaagaagcaaatgcttcactaggagatggacctgcgttgtattagctagttggtagggtaacggcctaccaaggctccgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagagaagaacgggtatgagagtggaaaattcatactgtgacggtatcttaccagaaagggacggctaactacgtgccagcagccgcggtaatacgtaggtcccgagcgttgtccggatttattgggcgtaaagcgagcgcaggtggttacataagtctgaagtaaaaggcagtggctcaaccattgtatgctttggaaactgtgtaacttgagtgcagaaggggagagtggaattccatgtgtagcggtgaaatgcgtagatatatggaggaacaccggtggcgaaagcggctctctggtctgtaactgacactgaggctcgaaagcgtggggagcaaacaggattagataccctggtagtccacgccgtaaacgatgagtgctaggtgttgggtcctttccgggactcagtgccgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccctctgaccgtcctagagataggatttcccttcggggcagaggagacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggttggtacaacgagtcgcaagccggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9308 - DNA, 1555 bp, Streptococcus vestibularis
  ref <308>: DATABASE ACCESSION NUMBER: NCBI ACCESSION: NZ_LR134275.1
  ref <309>: DATABASE ENTRY DATE: 2019-04-01
  ref <313>: RELEVANT RESIDUES IN SEQ ID NO: (1)..(1555)
ttaatgagagtttgatcctggctcaggacgaacgctggcggcgtgcctaatacatgcaagtagaacgctgaagagaggagcttgctcttcttgaatgagttgcgaacgggtgagtaacgcgtaggtaacctgccttgtagcgggggataactattggaaacgatagctaataccgcataacaatgggtgacacatgtcatttatttgaaaggggcaattgctccactacaagatggacctgcgttgtattagctagtaggtgaggtaacggctcacctaggcgacgatacatagccgacctgagagggtgatcggccacactgggactgagacacggcccagactcctacgggaggcagcagtagggaatcttcggcaatgggggcaaccctgaccgagcaacgccgcgtgagtgaagaaggttttcggatcgtaaagctctgttgtaagtcaagaacgagtgtgagagtggaaagttcacactgtgacggtagcttaccagaaagggacggctaactacgtgccagcagccgcggtaatacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacaggattagataccctggtagtccacgccgtaaacgatgagtgctaggtgttggatcctttccgggattcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcccgatgctatttctagagatagaaagttacttcggtacatcggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggttggtacaacgagttgcgagtcggtgacggcaagctaatctcttaaagccaatctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 9309 - DNA, 1555 bp, Streptococcus viridans
  ref <308>: DATABASE ACCESSION NUMBER: NCBI ACCESSION: NZ_LR134266.1
  ref <309>: DATABASE ENTRY DATE: 2019-04-01
  ref <313>: RELEVANT RESIDUES IN SEQ ID NO: (1)..(1555)
ttaatgagagtttgatcctggctcaggatgaacgctggcggcgtgcctaatacatgcaagtagaacgctgaagcttggtgcttgcaccgagcggatgagttgcgaacgggtgagtaacgcgtaggtaacctgcctggtagcgggggataactattggaaacgatagctaataccgcataacagtagatgttgcatgacatttacttgaaaggggcaattgctccactaccagatggacctgcgttgtattagctagttggtgaggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacaggattagataccctggtagtccacgccgtaaacgatgagtgctaggtgttgggtcctttccgggactcagtgccgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcattcagttgggcactctagcgagactgccggtaataaaccggaggaaggtggggatgacgtcaaatcatcatgccccttatgacctgggctacacacgtgctacaatggctggtacaacgagtcgcaagtcggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaagga

SEQ ID NO: 9310 - DNA, 1567 bp, Streptohalobacillus salinus
  ref <308>: DATABASE ACCESSION NUMBER: NCBI ACCESSION: NZ_QJJR01000027.1
  ref <309>: DATABASE ENTRY DATE: 2019-04-01
  ref <313>: RELEVANT RESIDUES IN SEQ ID NO: (1)..(1567)
tattgagagtttgatcttggctcaggacgaacgctggcggcgtgcctaatacatgcaagtcgagcgcaggaagctaaacggaccccttcggggtgaagcttagtggaatgagcggcggacgggtgagtaacacgtgggcaacctacctgtaagactgggataactcatggaaacgtgagctaataccggataagacatcgcttcacatgaagggatgatgaaagatggctccggctatcacttacagatgggcccgcggcgcattagctagttggtagggtaatggcctaccaaggcaacgatgcgtagccgacctgagagggtgatcggccacactgggactgagacacggcccagactcctacgggaggcagcagtagggaatcttccgcaatggacgaaagtctgacggagcaacgccgcgtgaacgatgaaggttttcggatcgtaaagttctgttgttagggaagaacacgtaccgttcgaatagggcggtatcttgacggtacctaacgagaaagccccggctaactacgtgccagcagccgcggtaatacgtagggggcaagcgttgtccggaattattgggcgtaaagcgcgcgcaggcggttctttaagtctgatgtgaaatcttgcggctcaaccgtaagcggtcattggaaactggagaacttgagtacagaagaggagagtggaattccatgtgtagcggtgaaatgcgtagatatatggaggaacaccagtggcgaaggcgactctctggtctgtaactgacgctgaggcgcgaaagcgtggggagcaaacaggattagataccctggtagtccacgccgtaaacgatgagtgctaggtgttagggggtttccgccccttagtgctgcagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctctgatacccctagagatagggcattcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggccgcgaaaccgcgaggtcaagcaaatcccataaaaccattctcagttcggattgtaggctgcaactcgcctacatgaagccggaatcgctagtaatcgtggatcagcatgccacggtgaatacgttcccgggtcttgtacacaccgcccgtcacaccacgagagtttgtaacacccgaagtcggtgaggtaaccttttaggagccagccgccgaaggtgggacgaatgattggggtgaagtcgtaacaaggtagccgtatcggaaggtgcggctggatcacctcctttcta

SEQ ID NO: 9311 - DNA, 1531 bp, Streptomyces acidiscabies
  ref <308>: DATABASE ACCESSION NUMBER: NCBI ACCESSION: NZ_PCGS01000895.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggatatcactcctgcctgcatgggcgggggtcgaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcgcgtcggatgtgaaagcccggggcttaaccccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaacggccagagatggtcgcccccttgtggtcggtgtacaggtggtgcatggctgtcgtcagctcgtgtcgtgagatgttgggttaagtcccgcaacgagcgcaacccttgtcctgtgttgccagcgtgcccttcggggtgacggggactcacaggagaccgccggggtcaactcggaggaaggtggggacgacgtcaagtcatcatgccccttatgtcttgggctgcacacgtgctacaatggcaggtacaaagagctgcgaaaccgtgaggtggagcgaatctcaaaaagcctgtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9312 - DNA, 1535 bp, Streptomyces afghaniensis
  ref <308>: DATABASE ACCESSION NUMBER: NCBI ACCESSION: NZ_KE354165.1
  ref <309>: DATABASE ENTRY DATE: 2019-04-01
  ref <313>: RELEVANT RESIDUES IN SEQ ID NO: (1)..(1535)
cattcacggagagtttgatcctggctcaggacgaacgctggcggcgtgcttaacacatgcaagtcgaacgatgaaccacttcggtggggattagtggcgaacgggtgagtaacacgtgggcaatctgccctgcactctgggacaagccctggaaacggggtctaataccggatacaaccactaggggcatctcttggtggtggaaagctccggcggtgcaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagtgaaagtgacggtacctgcagaagaagcgccggctaactacgtgccagcagccgcggtaatacgtagggcgcgagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaaaccctggagacagggtcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggacgtcacgggagaccgccggggtcgaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaactacgttccgggccttgtacacaccgcccgtcacgtcacgaaagtcggtaacacccgaagccggtggccgaacccccttcgtggggagggagctgtcgaaggtgggactggcgattgggacgaagtcgtaacaaggtagccgtaccggaaggtgcggctggatcacctcctttct

SEQ ID NO: 9313 - DNA, 1531 bp, Streptomyces alboflavus
  ref <308>: DATABASE ACCESSION NUMBER: NCBI ACCESSION: NZ_RHGC01000001.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaagcccttcggggtggattagtggcgaacgggtgagtaacacgtgggcaatctgccctgcactctgggacaagccctggaaacggggtctaataccggataacactctccaccgcatggtggggggttgaaagctccggcggtgcaggatgagcccgcggcctatcagcttgttggtgaggtagtggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaacggccagagatggtcgcccccttgtggtcggtgtacaggtggtgcatggctgtcgtcagctcgtgtcgtgagatgttgggttaagtcccgcaacgagcgcaacccttgtcccgtgttgccagcaagcccttcggggtgttggggactcacgggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9314 - DNA, 1534 bp, Streptomyces albulus
  ref <308>: DATABASE ACCESSION NUMBER: NCBI ACCESSION: NZ_BHXC01000006.1
  ref <309>: DATABASE ENTRY DATE: 2019-04-01
  ref <313>: RELEVANT RESIDUES IN SEQ ID NO: (1)..(1534)
cattcacggagagtttgatcctggctcaggacgaacgctggcggcgtgcttaacacatgcaagtcgaacgatgaacctccttcgggaggggattagtggcgaacgggtgagtaacacgtgggcaatctgcccttcactctgggacaagccctggaaacggggtctaataccggatatgacacggggtcgcatgatctccgtgtggaaagctccggcggtgaaggatgagcccgcggcctatcagcttgttggtgaggtagtggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcgagcgttgtccggaattattgggcgtaaagagctcgtaggcggcttgtcacgtcggatgtgaaagcccggggcttaaccccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgtcgtccgtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaaaccgtggagacatggtcccccttgtggtcggtgtacaggtggtgcatggctgtcgtcagctcgtgtcgtgagatgttgggttaagtcccgcaacgagcgcaacccttgttctgtgttgccagcatgcctttcggggtgatggggactcacaggagactgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggaatcgtcgaaggtgggactggcgattgggacgaagtcgtaacaaggtagccgtaccggaaggtgcggctggatcacctcctttcta

SEQ ID NO: 9315 - DNA, 1532 bp, Streptomyces albus
  ref <308>: DATABASE ACCESSION NUMBER: NCBI ACCESSION: NZ_CP033071.1
  ref <309>: DATABASE ENTRY DATE: 2019-04-01
  ref <313>: RELEVANT RESIDUES IN SEQ ID NO: (1)..(1532)
cattcacggagagtttgatcctggctcaggacgaacgctggcggcgtgcttaacacatgcaagtcgaacgatgaacccgcttcggtgggggattagtggcgaacgggtgagtaacacgtgggcaatctgccctgcactctgggacaagccctggaaacggggtctaataccggatattgacctgcttgggcatccaagtgggtggaaagctccggcggtgcaggatgagcccgcggcctatcagcttgttggtgaggtagtggctcaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggaagaagcgtgagtgacggtacctgcagaagaagcgccggctaactacgtgccagcagccgcggtaatacgtagggcgcaagcgttgtccggaattattgggcgtaaagagctcgtaggcggcttgtcgcgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaaactctggagacagggtcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgcaaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgcgggagggagctgtcgaaggtgggactggcgattgggacgaagtcgtaacaaggtagccgtaccggaaggtgcggctggatcacctcctttct

SEQ ID NO: 9316 - DNA, 1533 bp, Streptomyces alfalfae
  ref <308>: DATABASE ACCESSION NUMBER: NCBI ACCESSION: NZ_QYZT01000017.1
  ref <309>: DATABASE ENTRY DATE: 2019-04-01
  ref <313>: RELEVANT RESIDUES IN SEQ ID NO: (1)..(1533)
cattcacggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggataacactctctctcgcatgggagagggttgaaagctccggcggtgaaggatgagcccgcggcctatcagctagttggtgaggtagaagctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggaactaggtgtgggcgacattccacgtcgtccgtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaagcatcagagatggtgccccccttgtggtcggtgtacaggtggtgcatggctgtcgtcagctcgtgtcgtgagatgttgggttaagtcccgcaacgagcgcaacccttgtcccgtgttgccagcaagccccttcgggggtgttggggactcacgggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9317 - DNA, 1531 bp, Streptomyces brunneus
  ref <308>: DATABASE ACCESSION NUMBER: NCBI ACCESSION: NZ_CP034463.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggataccacttccactcgcatgggtgggggttgaaagctccggcggtgaaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaacggccagagatggtcgcccccttgtggtcggtgtacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggcaggtacaatgagctgcgaaaccgtgaggtggagcgaatctcaaaaagcctgtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggaccagcgattgggacgaagtcgtaacaaggtagccgtaccggaaggtgcggctggatcacctcctttcta

SEQ ID NO: 9318 - DNA, 1533 bp, Streptomyces clavuligerus
  ref <308>: DATABASE ACCESSION NUMBER: NCBI ACCESSION: NZ_CP032052.1
  ref <309>: DATABASE ENTRY DATE: 2019-04-01
  ref <313>: RELEVANT RESIDUES IN SEQ ID NO: (1)..(1533)
cattcacggagagtttgatcctggctcaggacgaacgctggcggcgtgcttaacacatgcaagtcgaacgatgaacccgcttcggtgggggattagtggcgaacgggtgagtaacacgtgggcaatctgccctgcactctgggacaagccctggaaacggggtctaataccggataccacccgggggcgcatgcccttgggttgaaagctccggcggtgcaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaagcattagagatagtgccccccttgtggtcggtgtacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaaagagctgcgaaaccgtgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9319 - DNA, 1758 bp, Streptomyces coelicolor
  ref <308>: DATABASE ACCESSION NUMBER: NCBI ACCESSION: NC_003888.3
  ref <309>: DATABASE ENTRY DATE: 2019-04-01
  ref <313>: RELEVANT RESIDUES IN SEQ ID NO: (1)..(1758)
gggtgagtacaaaggaagcgtccgttccttgagaactcaacagcgtgccaaaagtcaacgccagatatgttgataccccgacctgatcggatctccgttcgggttgaggttcctttgaagtaacacaacagcgaggacgctgtgaacggtcggattattcctccgactgttccgctctcgtggtgtcacccgattacgggtatacattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggatactgaccctcgcaggcatctgcgaggttcgaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaagcatcagagatggtgccccccttgtggtcggtgtacaggtggtgcatggctgtcgtcagctcgtgtcgtgagatgttgggttaagtcccgcaacgagcgcaacccttgtcccgtgttgccagcaagcccttcggggtgttggggactcacgggagaccgccggggtcaactcggaggaaggtggggacgacgtcaagtcatcatgccccttatgtcttgggctgcacacgtgctacaatggccggtacaatgagctgcgataccgcaaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttctaaggagcacatagccgactgcag

SEQ ID NO: 9320 - DNA, 1531 bp, Streptomyces collinus
  ref <308>: DATABASE ACCESSION NUMBER: NCBI ACCESSION: NC_021985.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggatatgagcttccaccgcatggtggaggctgtaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgattgtgaaagcccgaggcttaacctcgggtctgcagtcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaacgtctggagacaggcgcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagttggtaacacccgaagccggtggcccaaccccttgtgggagggagctgtcgaaggtgggactagcgattgggacgaagtcgtaacaaggtagccgtaccggaaggtgcggctggatcacctcctttcta

SEQ ID NO: 9321 - DNA, 1531 bp, Streptomyces corchorusii
  ref <308>: DATABASE ACCESSION NUMBER: NCBI ACCESSION: NZ_KQ948396.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggataccactctcgcaggcatctgtgagggttgaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaaaccctggagacagggtcccccttgtggtcggtgtacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagttggtaacacccgaagccggtggcccaaccccttgtgggagggagctgtcgaaggtgggactagcgattgggacgaagtcgtaacaaggtagccgtaccggaaggtgcggctggatcacctcctttcta

SEQ ID NO: 9322 - DNA, 1531 bp, Streptomyces cyaneus
  ref <308>: DATABASE ACCESSION NUMBER: NCBI ACCESSION: NZ_RQJW01000034.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaaccacttcggtggggattagtggcgaacgggtgagtaacacgtgggcaatctgccctgcactctgggacaagccctggaaacggggtctaataccggatatcacttccactcgcatgggtgggggtcgaaagctccggcggtgcaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaacggccagagatggtcgcccccttgtggtcggtgtacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggcaggtacaatgagctgcgataccgtgaggtggagcgaatctcaaaaagcctgtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9323 - DNA, 1531 bp, Streptomyces europaeiscabiei
  ref <308>: DATABASE ACCESSION NUMBER: NCBI ACCESSION: NZ_PCGU01000588.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggatacaacactctcgggcatccgatgagtgtggaaagctccggcggtgaaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcgagcgttgtccggaattattgggcgtaaagagctcgtaggcggtctgtcgcgtcggatgtgaaagcccggggcttaaccccgggtctgcattcgatacgggcagactagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaacggccagagatggtcgcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggcaggtacaatgagctgcgaagccgcgaggcggagcgaatctcaaaaagcctgtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaacccgtaagggagggagctgtcgaaggtgggactggcgattgggacgaagtcgtaacaaggtagccgtaccggaaggtgcggctggatcacctcctttcta

SEQ ID NO: 9324 - DNA, 1531 bp, Streptomyces flaveolus
  ref <308>: DATABASE ACCESSION NUMBER: NCBI ACCESSION: NZ_JNWV01000103.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggatacgagtttcacgggcatccgtgattctggaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggcactaggtgttggcgacattccacgtcgtcggtgccgcagctaacgcattaagtgccccgcctggggagtacggccgcaaggctaaaactcaaaggaattgacgggggcccgcacaagcagcggagcatgtggcttaattcgacgcaacgcgaagaaccttaccaaggcttgacatacaccggaaacgtctggagacaggcgcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaaagagctgcgataccgtgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagttggtaacacccgaagccggtggcccaaccccttgtgggagggagctgtcgaaggtgggactagcgattgggacgaagtcgtaacaaggtagccgtaccggaaggtgcggctggatcacctcctttcta

SEQ ID NO: 9325 - DNA, 1529 bp, Streptomyces flaveus
  ref <308>: DATABASE ACCESSION NUMBER: NCBI ACCESSION: NZ_JOCU01000120.1
  ref <309>: DATABASE ENTRY DATE: 2019-04-01
  ref <313>: RELEVANT RESIDUES IN SEQ ID NO: (1)..(1529)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggatacgagtttcacgggcatccgtgattctggaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggcactaggtgttggcgacattccacgtcgtcggtgccgcagctaacgcattaagtgccccgcctggggagtacggccgcaaggctaaaactcaaaggaattgacgggggcccgcacaagcagcggagcatgtggcttaattcgacgcaacgcgaagaaccttaccaaggcttgacatacaccggaaacgtctggagacaggcgcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaaagagctgcgataccgtgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagttggtaacacccgaagccggtggcccaaccccttgtgggagagctgtcgaaggtgggactagcgattgggacgaagtcgtaacaaggtagccgtaccggaaggtgcggctggatcacctcctttcta

SEQ ID NO: 9326 - DNA, 1533 bp, Streptomyces fradiae; identical to SEQ ID NO: 9316
  ref <308>: DATABASE ACCESSION NUMBER: NCBI ACCESSION: NZ_CP032266.1
  ref <309>: DATABASE ENTRY DATE: 2019-04-01
  ref <313>: RELEVANT RESIDUES IN SEQ ID NO: (1)..(1533)

SEQ ID NO: 9327 - DNA, 1531 bp, Streptomyces fulvissimus
  ref <308>: DATABASE ACCESSION NUMBER: NCBI ACCESSION: NC_021177.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaagcctttcggggtggattagtggcgaacgggtgagtaacacgtgggcaatctgcccttcactctgggacaagccctggaaacggggtctaataccggataacactctgtcctgcatgggacggggttaaaagctccggcggtgaaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcatcagagatggtgccccccttgtggtcggtatacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgatgccgcgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9328 - DNA, 1531 bp, Streptomyces fungicidicus
  ref <308>: DATABASE ACCESSION NUMBER: NCBI ACCESSION: NZ_CP023407.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggatatcactcctgcaggcatctgtaggggttgaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcgagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaagcattagagatagtgccccccttgtggtcggtgtacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaatgagctgcgaaaccgtgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagttggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9329 - DNA, 1524 bp, Streptomyces glauciniger
  ref <308>: DATABASE ACCESSION NUMBER: NCBI ACCESSION: NZ_FZOF01000081.1
  ref <309>: DATABASE ENTRY DATE: 2019-04-01
  ref <313>: RELEVANT RESIDUES IN SEQ ID NO: (1)..(1524)
cattcacggagagtttgatcctggctcaggacgaacgctggcggcgtgcttaacacatgcaagtcgaacggtgaagcccttcggggtggatcagtggcgaacgggtgagtaacacgtgggcaatctgccctgcactctgggacaagccctggaaacggggtctaataccggatattaccttcctctgcatgggggttggtggaaagctccggcggtgcaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcaccggctaactacgtgccagcagccgcggtaatacgtagggtgcgagcgttgtccggaattattgggcgtaaagagctcgtaggcggcttgtcgcgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgtcgtccgtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaacacccagagatgggtgcccccttgtggtcggtgtacaggtggtgcatggctgtcgtcagctcgtgtcgtgagatgttgggttaagtcccgcaacgagcgcaacccctgtcctgtgttgccagcggattatgccggggactcacaggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcagtgctgcggtgaatacgttcccgggccttgtacacaccgcccgtcacgtcacgaaagtcggtaacacccgaagccggtggcccaaccccttgtgggagggagtcgtcgaaggtgggactggcgattgggacgaagtcgtaacaaggtagccgtaccggaaggtgcggctggatcacctcctttcta

SEQ ID NO: 9330 - DNA, 1531 bp, Streptomyces globisporus
  ref <308>: DATABASE ACCESSION NUMBER: NCBI ACCESSION: NZ_QWFA01000072.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggataacactctgtcccgcatgggacggggttgaaagctccggcggtgaaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcatcagagatggtgccccccttgtggtcggtatacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgatgccgcgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9331 - DNA, 1529 bp, Streptomyces griseocarneus
  ref <308>: DATABASE ACCESSION NUMBER: NCBI ACCESSION: NZ_PENC01000045.1
  ref <309>: DATABASE ENTRY DATE: 2019-04-01
  ref <313>: RELEVANT RESIDUES IN SEQ ID NO: (1)..(1529)
cattcacggagagtttgatcctggctcaggacgaacgctggcggcgtgcttaacacatgcaagtcgaacgatgaagcctttcggggtggattagtggcgaacgggtgagtaacacgtgggcaatctgccctgcactctgggacaagccctggaaacggggtctaataccggatacgacctgccgaggcatcttggcgggtggaaagctccggcggtgcaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcgagcgttgtccggaattattgggcgtaaagagctcgtaggcggcttgtcgcgtcggatgtgaaagcccggggcttaaccccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggcactaggtgtgggccacattccacgtggtccgtgccgcagctaacgcattaagtgccccgcctggggagtacggccgcaaggctaaaactcaaaggaattgacgggggcccgcacaagcagcggagcatgtggcttaattcgacgcaacgcgaagaaccttaccaaggcttgacatacaccggaaagtgctagagatagtgccccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagttggagttgctagtaatcgcagatcagcattgctgcggtgaatacgttcccgggccttgtacacaccgcccgtcacgtcacgaaagtcggtaacacccgaagccggtggcccaacccttgtggagggagccgtcgaaggtgggactggcgattgggacgaagtcgtaacaaggtagccgtaccggaaggtgcggctggatcacctcctttcta

SEQ ID NO: 9332 - DNA, 1530 bp, Streptomyces griseofuscus
  ref <308>: DATABASE ACCESSION NUMBER: NCBI ACCESSION: NZ_PDES01000029.1
  ref <309>: DATABASE ENTRY DATE: 2019-04-01
  ref <313>: RELEVANT RESIDUES IN SEQ ID NO: (1)..(1530)
cattcacggagagtttgatcctggctcaggacgaacgctggcggcgtgcttaacacatgcaagtcgaacgatgaagcccttcggggtggattagtggcgaacgggtgagtaacacgtgggcaatctgccctgcactctgggacaagccctggaaacggggtctaataccggatatgaccatcttgggcatccttgatggtgtaaagctccggcggtgcaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgattgtgaaagctcggggcttaaccccgagtctgcagtcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaagcattagagatagtgccccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggaccagcgattgggacgaagtcgtaacaaggtagccgtaccggaaggtgcggctggatcacctcctttcta

SEQ ID NO: 9333 - DNA, 1531 bp, Streptomyces griseorubiginosus
  ref <308>: DATABASE ACCESSION NUMBER: NCBI ACCESSION: NZ_RJKZ01000001.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggataccactgctcaaggcatcttgggtggttgaaagctccggcggtgaaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaagcattagagatagtgccccccttgtggtcggtgtacaggtggtgcatggctgtcgtcagctcgtgtcgtgagatgttgggttaagtcccgcaacgagcgcaacccttgtcctgtgttgccagcgtgcccttcggggtgacggggactcacaggagaccgccggggtcaactcggaggaaggtggggacgacgtcaagtcatcatgccccttatgtcttgggctgcacacgtgctacaatggcaggtacaatgagctgcgataccgtgaggtggagcgaatctcaaaaagcctgtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9334 - DNA, 1530 bp, Streptomyces griseoviridis
  ref <308>: DATABASE ACCESSION NUMBER: NCBI ACCESSION: NZ_CP034687.1
  ref <309>: DATABASE ENTRY DATE: 2019-04-01
  ref <313>: RELEVANT RESIDUES IN SEQ ID NO: (1)..(1530)
cattcacggagagtttgatcctggctcaggacgaacgctggcggcgtgcttaacacatgcaagtcgaacgatgaagcccttcggggtggattagtggcgaacgggtgagtaacacgtgggcaatctgccctgcactctgggacaagccctggaaacggggtctaataccggatatgaccgtcttgggcatccttgacggtgtaaagctccggcggtgcaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaacgtctggagacaggcgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9335 - DNA, 1538 bp, Streptomyces hoynatensis
  ref <308>: DATABASE ACCESSION NUMBER: NCBI ACCESSION: NZ_RBAL01000049.1
  ref <309>: DATABASE ENTRY DATE: 2019-04-01
  ref <313>: RELEVANT RESIDUES IN SEQ ID NO: (1)..(1538)
cattcacggagagtttgatcctggctcaggacgaacgctggcggcgtgcttaacacatgcaagtcgaacgctgatccggtctttcggggctggtgatgagtggcgaacgggtgagtaacacgtgggtaatctgccccgcactctgggataagcccgggaaactgggtctaataccggatatgaccgatggtcgcatggctgttggtggaaagcttttgcggtgtgggatgggcccgcggcctatcagcttgttggtggggtgatggcctaccaaggcgacgacgggtagccggcctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcagcagggaagaagcgtgagtgacggtacctgcagaagaagcaccggctaactacgtgccagcagccgcggtaatacgtagggtgcgagcgttgtccggaattattgggcgtaaagagctcgtaggcggtttgtcgcgtcggttgtgaaagcccggggcttaactccgggtctgcagtcgatacgggcaggctagagttcggcaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacggtgggaactaggtgtgggcagcattccacgttgtctgtgccgtagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacgccggacagctgcagagatgtggtttctctttgagtcggtgtacaggtggtgcatggctgtcgtcagctcgtgtcgtgagatgttgggttaagtcccgcaacgagcgcaacccttgtcctgtgttgccagcacgctctttttgggtggtggggactcacgggagactgccggggtcaactcggaggaaggtggggacgacgtcaagtcatcatgccccttatgtcttgggctgcacacgtgctacaatggccggtacaatgagctgcgatgccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagccgtcgaaggtgggactggcgattgggacgaagtcgtaacaaggtagccgtaccggaaggtgcggctggatcacctcctttcta

SEQ ID NO: 9336 - DNA, 1531 bp, Streptomyces hundungensis
  ref <308>: DATABASE ACCESSION NUMBER: NCBI ACCESSION: NZ_CP032698.1
  ref <309>: DATABASE ENTRY DATE: 2019-04-01
  ref <313>: RELEVANT RESIDUES IN SEQ ID NO: (1)..(1531)
cattcatggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggataacactcctcagggcatcttgaggggttaaaagctccggcggtgaaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaacggctagagatagtcgcccccttgtggtcggtatacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaaagagctgcgatgccgcgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9337 - DNA, 1522 bp, Streptomyces hyalinus
  ref <308>: DATABASE ACCESSION NUMBER: NCBI ACCESSION: NZ_BIFH01000075.1
  ref <309>: DATABASE ENTRY DATE: 2019-04-01
  ref <313>: RELEVANT RESIDUES IN SEQ ID NO: (1)..(1522)
ggagagtttgatcctggctcaggacgaacgctggcggcgtgcttaacacatgcaagtcgaacgctgaagcccttcggggtggatgagtggcgaacgggtgagtaacacgtgggcaacctgccctgcactctgggataacttcgggaaaccggagctaataccggataacatcctcctccgcatggtggggggttgaaagttccggcggtgcaggatgggcccgcggcctatcagcttgttggtggggtagtggcctaccaaggcgacgacgggtagccggcctgagagggcgaccggccacactgggactgagacacggcccagactcctacgggaggcagcagtggggaatattgcgcaatgggcgaaagcctgacgcagcgacgccgcgtgagggatgacggccttcgggttgtaaacctctttcagcagggaagaagcgcgagtgacggtacctgcagaagaagcaccggctaactacgtgccagcagccgcggtaatacgtagggtgcgagcgttgtccggaattattgggcgtaaagagctcgtaggcggcctgtcgcgtcggatgtgaaaactcggggcttaaccccgagcctgcattcgatacgggcaggctagagttcggcaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgccgtaaacgttgggaactaggtgtgggcgacattccacgtcgtccgtgccgcagctaacgcattaagttccccgcctggggagtacggccgcaaggctaaaactcaaaggaattgacgggggcccgcacaagaggcggagcatgtggcttaattcgacgcaacgcgaagaaccttaccaaggcttgacatacaccggaaacatctggagacaggtgccccttttggtcggtgtacaggtggtgcatggctgtcgtcagctcgtgtcgtgagatgttgggttaagtcccgcaacgagcgcaaccctcgttctgtgttgccagcatgcctttcggggtgatggggactcacaggagactgccggggtcaactcggaggaaggtggggacgacgtcaagtcatcatgccccttatgtcttgggctgcacacgtgctacaatggccggtacaatgagctgcgataccgcaaggtggagcgaatctcaaaaagccggtctcagttcggatcggggtctgcaactcgaccccgtgaagtcggagtctctagtaatcgcagatcagcattgctgcggtgaatacgttcccgggccttgtacacaccgcccgtcacgtcacgaaagtcggtaacacccgaagccggtggcccaactcgcaagagggggagccgtcgaaggtgggaccagcgattgggacgaagtcgtaacaaggtagccgtaccggaaggtgcggctggatcacctcctttcta

SEQ ID NO: 9338 - DNA, 1528 bp, Streptomyces hyaluromycini
  ref <308>: DATABASE ACCESSION NUMBER: NCBI ACCESSION: NZ_BCFL01000051.1
  ref <309>: DATABASE ENTRY DATE: 2019-04-01
  ref <313>: RELEVANT RESIDUES IN SEQ ID NO: (1)..(1528)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggatatgagcctgggaggcatctcctgggttgtaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgattgtgaaagcccgaggcttaacctcgggtctgcagtcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaacgtccagagatgggcgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccttgtggagggagctgtcgaaggtgggactggcgattgggacgaagtcgtaacaaggtagccgtaccggaaggtgcggctggatcacctcctttcta

SEQ ID NO: 9339 - DNA, 953 bp, Streptomyces klenkii
  ref <308>: DATABASE ACCESSION NUMBER: NCBI ACCESSION: NZ_RBAM01000048.1
  ref <309>: DATABASE ENTRY DATE: 2019-04-01
  ref <313>: RELEVANT RESIDUES IN SEQ ID NO: (1)..(953)
aagcccggggcttaactccgggtctgcagtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacggtgggaactaggtgtgggcgacattccacgttgtctgtgccgtagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacgccggaaatctctggagacaggggctcccttttgggccggtgtacaggtggtgcatggctgtcgtcagctcgtgtcgtgagatgttgggttaagtcccgcaacgagcgcaacccttgtcctgtgttgccagcaacaccttcgggtggttggggactcacgggagactgccggggtcaactcggaggaaggtggggacgacgtcaagtcatcatgccccttatgtcttgggctgcacacgtgctacaatggccggtacaaagggctgcgatgccgtgaggcggagcgaatcccaaaaagccggtctcagttcggattggggtctgcaactcgaccccatgaagtcggagtcgctagtaatcgcagatcagcagtgctgcggtgaatacgttcccgggccttgtacacaccgcccgtcacgtcacgaaagtcggtaacacccgaagccggtggcctaacccccttgtggggagggagccgtcgaaggtgggactggcgattgggacgaagtcgtaacaaggtagccgtaccggaaggtgcggctggatcacctcctttcta

SEQ ID NO: 9340 - DNA, 1530 bp, Streptomyces koyangensis
  ref <308>: DATABASE ACCESSION NUMBER: NCBI ACCESSION: NZ_CP031742.1
  ref <309>: DATABASE ENTRY DATE: 2019-04-01
  ref <313>: RELEVANT RESIDUES IN SEQ ID NO: (1)..(1530)
cattcacggagagtttgatcctggctcaggacgaacgctggcggcgtgcttaacacatgcaagtcgaacgatgaagcccttcggggtggattagtggcgaacgggtgagtaacacgtgggcaatctgccctgcactctgggacaagccctggaaacggggtctaataccggatatgactgtccaccgcatggtggatggtgtaaagctccggcggtgcaggatgagcccgcggcctatcagctagttggtgaggtagtggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaacgtctggagacaggcgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9341 - DNA, 1533 bp, Streptomyces lushanensis
  ref <308>: DATABASE ACCESSION NUMBER: NCBI ACCESSION: NZ_MAUD01000416.1
  ref <309>: DATABASE ENTRY DATE: 2019-04-01
  ref <313>: RELEVANT RESIDUES IN SEQ ID NO: (1)..(1533)
cattcacggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggataacactgttccctgcatgggggatggttgaaagctccggcggtgaaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggaagaagcgtgagtgacggtacctgcagaagaagcgccggctaactacgtgccagcagccgcggtaatacgtagggcgcaagcgttgtccggaattattgggcgtaaagagctcgtaggcggcctgtcgcgtcggatgtgaaagcccggggctcaaccccgggtctgcattcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaactggcagagatgtcagcccccttgtggtcggtgtacaggtggtgcatggctgtcgtcagctcgtgtcgtgagatgttgggttaagtcccgcaacgagcgcaacccttgttctgtgttgccagcatgcctttcggggtgatggggactcacaggagactgccggggtcaactcggaggaaggtggggacgacgtcaagtcatcatgccccttatgtcttgggctgcacacgtgctacaatggccggtacaatgagctgcgatgccgtgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaacccccttgcggggagggagctgtcgaaggtgggactggcgattgggacgaagtcgtaacaaggtagccgtaccggaaggtgcggctggatcacctcctttcta

SEQ ID NO: 9342 - DNA, 1529 bp, Streptomyces luteoverticillatus
  ref <308>: DATABASE ACCESSION NUMBER: NCBI ACCESSION: NZ_CP034587.1
  ref <309>: DATABASE ENTRY DATE: 2019-04-01
  ref <313>: RELEVANT RESIDUES IN SEQ ID NO: (1)..(1529)
cattcacggagagtttgatcctggctcaggacgaacgctggcggcgtgcttaacacatgcaagtcgaacgatgaagcccttcggggtggattagtggcgaacgggtgagtaacacgtgggcaatctgccctgcactctgggacaagccctggaaacggggtctaataccggatatgactactgaccgcatggttggtggtggaaagctccggcggtgcaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcgcgtcggatgtgaaagcccggggcttaaccccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgtcgtccgtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaacggccagagatggtcgcccccttgtggtcggtgtacaggtggtgcatggctgtcgtcagctcgtgtcgtgagatgttgggttaagtcccgcaacgagcgcaacccttgtcctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgatgccgtgaggtggagcgaatctcaaaaagccggtctcagttcggattggggtctgcaactcgaccccatgaagttggagttgctagtaatcgcagatcagcattgctgcggtgaatacgttcccgggccttgtacacaccgcccgtcacgtcacgaaagtcggtaacacccgaagccggtggcccaacccttgtggagggagccgtcgaaggtgggactggcgattgggacgaagtcgtaacaaggtagccgtaccggaaggtgcggctggatcacctcctttcta

SEQ ID NO: 9343 - DNA, 1534 bp, Streptomyces lydicus
  ref <308>: DATABASE ACCESSION NUMBER: NCBI ACCESSION: NZ_RDTC01000001.1
  ref <309>: DATABASE ENTRY DATE: 2019-04-01
  ref <313>: RELEVANT RESIDUES IN SEQ ID NO: (1)..(1534)
cattcacggagagtttgatcctggctcaggacgaacgctggcggcgtgcttaacacatgcaagtcgaacgatgaacctccttcgggaggggattagtggcgaacgggtgagtaacacgtgggcaatctgcccttcactctgggacaagccctggaaacggggtctaataccggatacgaccaccgaccgcatggtctggtggtggaaagctccggcggtgaaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgtcgtccgtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaaaccctggagacagggtcccccttgtggtcggtttacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggaatcgtcgaaggtgggactggcgattgggacgaagtcgtaacaaggtagccgtaccggaaggtgcggctggatcacctcctttcta

SEQ ID NO: 9344 - DNA, 1530 bp, Streptomyces nigra
  ref <308>: DATABASE ACCESSION NUMBER: NCBI ACCESSION: NZ_CP029043.1
  ref <309>: DATABASE ENTRY DATE: 2019-04-01
  ref <313>: RELEVANT RESIDUES IN SEQ ID NO: (1)..(1530)
cattcacggagagtttgatcctggctcaggacgaacgctggcggcgtgcttaacacatgcaagtcgaacgatgaaccacttcggtggggattagtggcgaacgggtgagtaacacgtgggcaatctgccctgcactctgggacaagccctggaaacggggtctaataccggatactgagccacttgggcatccaagtggttcgaaagctccggcggtgcaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaacgtccagagatgggcgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttct

SEQ ID NO: 9345 - DNA, 1530 bp, Streptomyces odonnellii
  ref <308>: DATABASE ACCESSION NUMBER: NCBI ACCESSION: NZ_LATD01000204.1
  ref <309>: DATABASE ENTRY DATE: 2019-04-01
  ref <313>: RELEVANT RESIDUES IN SEQ ID NO: (1)..(1530)
cattcacggagagtttgatcctggctcaggacgaacgctggcggcgtgcttaacacatgcaagtcgaacgatgaagcctttcggggtggattagtggcgaacgggtgagtaacacgtgggcaatctgcccttcactctgggacaagccctggaaacggggtctaataccggataatactcttctctgcatgggggagggttgaaagctccggcggtggaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggaagaagcgtgagtgacggtacctgcagaagaagcgccggctaactacgtgccagcagccgcggtaatacgtagggcgcaagcgttgtccggaattattgggcgtaaagagctcgtaggcggcttgtcgcgtcggatgtgaaagcccggggctcaaccccgggtctgcattcgatacgggcaggctggagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggtaactggcagagatgtcagcccccttgtggtcggtgtacaggtggtgcatggctgtcgtcagctcgtgtcgtgagatgttgggttaagtcccgcaacgagcgcaacccttgttctgtgttgccagcatgcctttcggggtgatggggactcacaggagactgccggggtcaactcggaggaaggtggggacgacgtcaagtcatcatgccccttatgtcttgggctgcacacgtgctacaatggccggtacaatgagctgcgatgccgtgaggcggagcgaatctcaaaaagccggtctcagttcggattggggtctgcaactcgaccccatgaagtcggagttgctagtaatcgcagatcagcagtgctgcggtgaatacgttcccgggccttgtacacaccgcccgtcacgtcacgaaagtcggtaacacccgaagccggtggcccaacccctcggggagggagctgtcgaaggtgggactggcgattgggacgaagtcgtaacaaggtagccgtaccggaaggtgcggctggatcacctcctttcta

SEQ ID NO: 9346 - DNA, 1534 bp, Streptomyces olivaceus
  ref <308>: DATABASE ACCESSION NUMBER: NCBI ACCESSION: NZ_CP016795.1
  ref <309>: DATABASE ENTRY DATE: 2019-04-01
  ref <313>: RELEVANT RESIDUES IN SEQ ID NO: (1)..(1534)
cattcacggagagtttgatcctggctcaggacgaacgctggcggcgtgcttaacacatgcaagtcgaacgatgaaccacttcggtggggattagtggcgaacgggtgagtaacacgtgggcaatctgccctgcactctgggacaagccctggaaacggggtctaataccggatattgaccttcacgggcatctgtgaggttcgaaagctccggcggtgcaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaacggccagagatggtcgcccccttgtggtcggtgtacaggtggtgcatggctgtcgtcagctcgtgtcgtgagatgttgggttaagtcccgcaacgagcgcaacccttgtcccgtgttgccagcaagctccttcgggggtgttggggactcacgggagaccgccggggtcaactcggaggaaggtggggacgacgtcaagtcatcatgccccttatgtcttgggctgcacacgtgctacaatggccggtacaatgagctgcgataccgcaaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9347 - DNA, 1529 bp, Streptomyces olivoreticuli
  ref <308>: DATABASE ACCESSION NUMBER: NCBI ACCESSION: NZ_CP031455.1
  ref <309>: DATABASE ENTRY DATE: 2019-04-01
  ref <313>: RELEVANT RESIDUES IN SEQ ID NO: (1)..(1529)
cattcacggagagtttgatcctggctcaggacgaacgctggcggcgtgcttaacacatgcaagtcgaacgatgaagcctttcggggtggattagtggcgaacgggtgagtaacacgtgggcaatctgccctgcactctgggacaagccctggaaacggggtctaataccggataatacctgccgaggcatctcggtgggttgaaagctccggcggtgcaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgttgcgtcggatgtgaaagcccggggcttaaccccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgtcgtccgtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaacggccagagatggtcgcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagttggagttgctagtaatcgcagatcagcattgctgcggtgaatacgttcccgggccttgtacacaccgcccgtcacgtcacgaaagtcggtaacacccgaagccggtggcccaacccttgtggagggagccgtcgaaggtgggactggcgattgggacgaagtcgtaacaaggtagccgtaccggaaggtgcggctggatcacctcctttcta

SEQ ID NO: 9348 - DNA, 1532 bp, Streptomyces ossamyceticus
  ref <308>: DATABASE ACCESSION NUMBER: NCBI ACCESSION: NZ_RJKY01000001.1
  ref <309>: DATABASE ENTRY DATE: 2019-04-01
  ref <313>: RELEVANT RESIDUES IN SEQ ID NO: (1)..(1532)
cattcacggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggatacgacgcgctcgggcatccgatgtgcgtggaaagctccggcggtgaaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcgagcgttgtccggaattattgggcgtaaagagctcgtaggcggtctgtcacgtcggatgtgaaagcccggggcttaaccccgggtctgcattcgatacgggcagactagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacgccggaaaaccctggagacagggtcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggcaggtacaatgagctgcgaagccgtgaggcggagcgaatctcaaaaagcctgtctcagttcggattggggtctgcaactcgaccccatgaagtcggagttgctagtaatcgcagatcagcagtgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9349 - DNA, 1532 bp, Streptomyces rapamycinicus
  ref <308>: DATABASE ACCESSION NUMBER: NCBI ACCESSION: NZ_QYCY01000001.1
  ref <309>: DATABASE ENTRY DATE: 2019-04-01
  ref <313>: RELEVANT RESIDUES IN SEQ ID NO: (1)..(1532)
cattcacggagagtttgatcctggctcaggacgaacgctggcggcgtgcttaacacatgcaagtcgaacgatgaaccggtttcggccggggattagtggcgaacgggtgagtaacacgtgggcaatctgccctgcactctgggacaagccctggaaacggggtctaataccggatatgactaccgaccgcatggtctggtggtggaaagctccggcggtgcaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcgcgtcggatgtgaaagcccggggcttaaccccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgttgtccgcgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacatcggaaacatccagagatgggtgcccccttgtggtcggtgtacaggtggtgcatggctgtcgtcagctcgtgtcgtgagatgttgggttaagtcccgcaacgagcgcaacccttgttctgtgttgccagcatgcctttcggggtgatggggactcacaggagactgccggggtcaactcggaggaaggtggggacgacgtcaagtcatcatgccccttatgtcttgggctgcacacgtgctacaatggccggtacaatgagctgcgaagccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccttgtggagggagctgtcgaaggtgggactggcgattgggacgaagtcgtaacaaggtagccgtaccggaaggtgcggctggatcacctcctttcta

SEQ ID NO: 9350 - DNA, 801 bp, Streptomyces rimosus
  ref <308>: DATABASE ACCESSION NUMBER: NCBI ACCESSION: NZ_SADA01000187.1
  ref <309>: DATABASE ENTRY DATE: 2019-04-01
  ref <313>: RELEVANT RESIDUES IN SEQ ID NO: (1)..(801)
gagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgtcgtccgtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaacctctggagacaggggcccccttgtggtcggtgtacaggtggtgcatggctgtcgtcagctcgtgtcgtgagatgttgggttaagtcccgcaacgagcgcaacccttgttctgtgttgccagcatgcctttcggggtgatggggactcacaggagactgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggccc

SEQ ID NO: 9351 - DNA, 1531 bp, Streptomyces scabiei
  ref <308>: DATABASE ACCESSION NUMBER: NCBI ACCESSION: NZ_PCGT01001009.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggatacgacactctcgggcatccgatgagtgtggaaagctccggcggtgaaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcgagcgttgtccggaattattgggcgtaaagagctcgtaggcggtctgtcgcgtcggatgtgaaagcccggggcttaaccccgggtctgcattcgatacgggcagactagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaacggccagagatggtcgcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggcaggtacaatgagctgcgaagccgtgaggcggagcgaatctcaaaaagcctgtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaacccgtaagggagggagctgtcgaaggtgggactggcgattgggacgaagtcgtaacaaggtagccgtaccggaaggtgcggctggatcacctcctttcta

SEQ ID NO: 9352 - DNA, 1531 bp, Streptomyces scopuliridis
  ref <308>: DATABASE ACCESSION NUMBER: NCBI ACCESSION: NZ_AZSP01000066.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaagcctttcggggtggattagtggcgaacgggtgagtaacacgtgggcaatctgcccttcactctgggacaagccctggaaacggggtctaataccggataatacttctgcctgcatgggcgggggttgaaagctccggcggtgaaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcgcgtcggatgtgaaagcccggggcttaaccccgggtctgcattcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaacggccagagatggtcgcccccttgtggtcggtgtacaggtggtgcatggctgtcgtcagctcgtgtcgtgagatgttgggttaagtcccgcaacgagcgcaacccttgttctgtgttgccagcatgcctttcggggtgatggggactcacaggagactgccggggtcaactcggaggaaggtggggacgacgtcaagtcatcatgccccttatgtcttgggctgcacacgtgctacaatggccggtacaatgagctgcgatgccgcgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9353 - DNA, 1528 bp, Streptomyces shenzhenensis
  ref <308>: DATABASE ACCESSION NUMBER: NCBI ACCESSION: NZ_PENI01000074.1
  ref <309>: DATABASE ENTRY DATE: 2019-04-01
  ref <313>: RELEVANT RESIDUES IN SEQ ID NO: (1)..(1528)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggatatgagcctgggaggcatctcctgggttgtaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgattgtgaaagcccgaggcttaacttcgggtctgcagtcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaagcattagagatagtgccccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgatgccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccttgtggagggagctgtcgaaggtgggactggcgattgggacgaagtcgtaacaaggtagccgtaccggaaggtgcggctggatcacctcctttcta

SEQ ID NO: 9354 - DNA, 1531 bp, Streptomyces showdoensis
  ref <308>: DATABASE ACCESSION NUMBER: NCBI ACCESSION: NZ_LAQS01000146.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggatacgacctgccgaggcatctcggcgggtggaaagctccggcggtgaaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcatccgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcattagagatagtgccccccttgtggtcggtatacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaaagagctgcgatgccgcgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9355 - DNA, 1534 bp, Streptomyces sioyaensis
  ref <308>: DATABASE ACCESSION NUMBER: NCBI ACCESSION: NZ_SDIF01000224.1
  ref <309>: DATABASE ENTRY DATE: 2019-04-01
  ref <313>: RELEVANT RESIDUES IN SEQ ID NO: (1)..(1534)
cattcacggagagtttgatcctggctcaggacgaacgctggcggcgtgcttaacacatgcaagtcgaacgatgaacctccttcgggaggggattagtggcgaacgggtgagtaacacgtgggcaatctgcccttcactctgggacaagccctggaaacggggtctaataccggatacgacacacgaccgcatggtctgtgtgtggaaagctccggcggtgaaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcgcgtcggatgtgaaagcccggggcttaaccccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgtcgtccgtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaaaccctggagacagggtcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggaatcgtcgaaggtgggactggcgattgggacgaagtcgtaacaaggtagccgtaccggaaggtgcggctggatcacctcctttcta

SEQ ID NO: 9356 - DNA, 1532 bp, Streptomyces sp. 11-1-2
  ref <308>: DATABASE ACCESSION NUMBER: NCBI ACCESSION: NZ_CP022545.1
  ref <309>: DATABASE ENTRY DATE: 2019-04-01
  ref <313>: RELEVANT RESIDUES IN SEQ ID NO: (1)..(1532)
cattcacggagagtttgatcctggctcaggacgaacgctggcggcgtgcttaacacatgcaagtcgaacgatgaaccggtttcggccggggattagtggcgaacgggtgagtaacacgtgggcaatctgccctgcactctgggacaagccctggaaacggggtctaataccggatatgacacgctcccgcatgggatgcgtgtggaaagctccggcggtgcaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcgcgtcggatgtgaaagcccggagcttaactccgggtctgcattcgatacgggcaggctagagttcggtaggggagatcggaattcctggtgtagcggtgaaatgcgcagatatcaggaggaacaccggtggcgaaggcggatctctgggccgacactgacgctgaggagcgaaagcgtggggagcgaacaggattagataccctggtagtccacgccgtaaacgttgggaactaggtgtgggcgacattccacgttgtccgcgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaacctctggagacaggggcccccttgtggtcggtgtacaggtggtgcatggctgtcgtcagctcgtgtcgtgagatgttgggttaagtcccgcaacgagcgcaacccttgttctgtgttgccagcatgcctttcggggtgatggggactcacaggagactgccggggtcaactcggaggaaggtggggacgacgtcaagtcatcatgccccttatgtcttgggctgcacacgtgctacaatggccggtacaatgagctgcgaagccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccttgtggggggagccgtcgaaggtgggactggcgattgggacgaagtcgtaacaaggtagccgtaccggaaggtgcggctggatcacctcctttcta

SEQ ID NO: 9357 - DNA, 1529 bp, Streptomyces sp. 1114.5
  ref <308>: DATABASE ACCESSION NUMBER: NCBI ACCESSION: NZ_RBXE01000001.1
  ref <309>: DATABASE ENTRY DATE: 2019-04-01
  ref <313>: RELEVANT RESIDUES IN SEQ ID NO: (1)..(1529)
cattcacggagagtttgatcctggctcaggacgaacgctggcggcgtgcttaacacatgcaagtcgaacggtgaagcccttcggggtggatcagtggcgaacgggtgagtaacacgtgggcaatctgccctgcactctgggacaagccctggaaacggggtctaataccggatatgacccgggagcgcatgctctcgggtggaaagctccggcggtgcaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgcaagtgacggtacctgcagaagaagcaccggctaactacgtgccagcagccgcggtaatacgtagggtgcgagcgttgtccggaattattgggcgtaaagagctcgtaggcggcctgtcgcgtcggatgtgaaagcccggggcttaaccccgggtctgcattcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatatgccggaaacacctggagacaggtgcccccttgtggtcggtatacaggtggtgcatggttgtcgtcagctcgtgtcgtgagatgttgggttaagtcccgcaacgagcgcaacccttgttctgtgttgccagcatgcctttcggggtgatggggactcacaggagactgccggggtcaactcggaggaaggtggggacgacgtcaaatcatcatgccccttatgtcttgggctgcacacgtgctacaatggtcggtacaaagggctgcgatgccgtgaggcggagcgaatcccaaaaagccggcctcagttcggattggggtctgcaactcgaccccatgaagttggagttgctagtaatcgcagatcagcatgctgcggtgaatacgttcccgggccttgtacacaccgcccgtcacgtcacgaaagtcggtaacacccgaagccggtggcctaacccgtaaggggaggagccgtcgaaggtgggaccagcgattgggacgaagtcgtaacaaggtagccgtaccggaaggtgcggctggatcacctcctttcta

SEQ ID NO: 9358 - DNA, 1532 bp, Streptomyces sp. 19
  ref <308>: DATABASE ACCESSION NUMBER: NCBI ACCESSION: NZ_QXDG01000001.1
  ref <309>: DATABASE ENTRY DATE: 2019-04-01
  ref <313>: RELEVANT RESIDUES IN SEQ ID NO: (1)..(1532)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggatactgacccttgcaggcatctgcgaggttcgaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaagcatcagagatggtgccccccttgtggtcggtgtacaggtggtgcatggctgtcgtcagctcgtgtcgtgagatgttgggttaagtcccgcaacgagcgcaacccttgtcccgtgttgccagcaagcccttcggggtgttggggactcacgggagaccgccggggtcaactcggaggaaggtggggacgacgtcaagtcatcatgccccttatgtcttgggctgcacacgtgctacaatggccggtacaatgagctgcgataccgcaaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9359 - DNA, 1534 bp, Streptomyces sp. 2112.5
  ref <308>: DATABASE ACCESSION NUMBER: NCBI ACCESSION: NZ_RAPL01000001.1
  ref <309>: DATABASE ENTRY DATE: 2019-04-01
  ref <313>: RELEVANT RESIDUES IN SEQ ID NO: (1)..(1534)
cattcacggagagtttgatcctggctcaggacgaacgctggcggcgtgcttaacacatgcaagtcgaacgatgaacctccttcgggaggggattagtggcgaacgggtgagtaacacgtgggcaatctgcccttcactctgggacaagccctggaaacggggtctaataccggatacgacctccgaccgcatggtctggtggtggaaagctccggcggtgaaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgtcgtccgtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaaaccctggagacagggtcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggaatcgtcgaaggtgggactggcgattgggacgaagtcgtaacaaggtagccgtaccggaaggtgcggctggatcacctcctttcta

SEQ ID NO: 9360 - DNA, 1530 bp, Streptomyces sp. 2132.2
  ref <308>: DATABASE ACCESSION NUMBER: NCBI ACCESSION: NZ_RJUZ01000001.1
  ref <309>: DATABASE ENTRY DATE: 2019-04-01
  ref <313>: RELEVANT RESIDUES IN SEQ ID NO: (1)..(1530)
cattcatggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggataatactcctgcctgcatgggcgggggttgaaagctccggcggtgaaggatgagcccgcggcctatcagcttgttggtggggtaatggcccaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccgaggcttaacctcgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatataccggaaagcattagagatagtgccccccttgtggtcggtatacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccgtaagggagggagctgtcgaaggtgggactggcgattgggacgaagtcgtaacaaggtagccgtaccggaaggtgcggctggatcacctcctttcta

SEQ ID NO: 9361 - DNA, 1534 bp, Streptomyces sp. 2233.2
  ref <308>: DATABASE ACCESSION NUMBER: NCBI ACCESSION: NZ_QXDE01000001.1
  ref <309>: DATABASE ENTRY DATE: 2019-04-01
  ref <313>: RELEVANT RESIDUES IN SEQ ID NO: (1)..(1534)
cattcacggagagtttgatcctggctcaggacgaacgctggcggcgtgcttaacacatgcaagtcgaacgatgaacctccttcgggaggggattagtggcgaacgggtgagtaacacgtgggcaatctgcccttcactctgggacaagccctggaaacggggtctaataccggatacgacctccgaccgcatggtctggtggtggaaagctccggcggtgaaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgtcgtccgtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaaaccctggagacagggtcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgataccgcaaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggaatcgtcgaaggtgggactggcgattgggacgaagtcgtaacaaggtagccgtaccggaaggtgcggctggatcacctcctttcta

SEQ ID NO: 9362 - DNA, 1530 bp, Streptomyces sp. 3211.1; identical to SEQ ID NO: 9360
  ref <308>: DATABASE ACCESSION NUMBER: NCBI ACCESSION: NZ_QXDI01000001.1
  ref <309>: DATABASE ENTRY DATE: 2019-04-01
  ref <313>: RELEVANT RESIDUES IN SEQ ID NO: (1)..(1530)

SEQ ID NO: 9363 - DNA, 1531 bp, Streptomyces sp. 3211.6
  ref <308>: DATABASE ACCESSION NUMBER: NCBI ACCESSION: NZ_RBXC01000001.1
  ref <309>: DATABASE ENTRY DATE: 2019-04-01
  ref <313>: RELEVANT RESIDUES IN SEQ ID NO: (1)..(1531)
cattcatggagagtttgatcctggctcaggacgaacgctggcggcgtgcttaacacatgcaagtcgaacgatgaacctccttcgggaggggattagtggcgaacgggtgagtaacacgtgggcaatctgcccttcactctgggacaagccctggaaacggggtctaataccggatacgactgcgggaggcatctcctgtggtggaaagctccggcggtgaaggatgagcccgcggcctatcagcttgttggtggggtaacggcccaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccgaggcttaacctcgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatataccggaaagcattagagatagtgccccccttgtggtcggtatacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccttgtggagggagctgtcgaaggtgggactggcgattgggacgaagtcgtaacaaggtagccgtaccggaaggtgcggctggatcacctcctttcta

SEQ ID NO: 9364 - DNA, 1531 bp, Streptomyces sp. 3212.2
  ref <308>: DATABASE ACCESSION NUMBER: NCBI ACCESSION: NZ_QEOG01000001.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggataatacctgcccgggcatctgggtgggttaaaagctccggcggtgaaggatgagcccgcggcctatcagcttgttggtgaggtagtggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaagcattagagatagtgccccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggcaggtacaatgagctgcgaagccgtgaggcggagcgaatctcaaaaagcctgtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9365 - DNA, 1529 bp, Streptomyces sp. 3212.3
  ref <308>: DATABASE ACCESSION NUMBER: NCBI ACCESSION: NZ_QTTM01000001.1
  ref <309>: DATABASE ENTRY DATE: 2019-04-01
  ref <313>: RELEVANT RESIDUES IN SEQ ID NO: (1)..(1529)
cattcacggagagtttgatcctggctcaggacgaacgctggcggcgtgcttaacacatgcaagtcgaacgatgaagcccttcggggtggattagtggcgaacgggtgagtaacacgtgggcaatctgccctgcactctgggacaagccctggaaacggggtctaataccggatacgagcctcccgggcatctgggaggttggaaagctccggcggtgcaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcgcgtcgattgtgaaagcccggggcttaactccgggtctgcagtcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggcactaggtgttggcgacattccacgtcgtcggtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaacatccagagatgggtgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccctcggggagggagctgtcgaaggtgggactggcgattgggacgaagtcgtaacaaggtagccgtaccggaaggtgcggctggatcacctcctttcta

SEQ ID NO: 9366 - DNA, 1531 bp, Streptomyces sp. 3212.4
  ref <308>: DATABASE ACCESSION NUMBER: NCBI ACCESSION: NZ_RBIY01000001.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaagcccttcggggtggattagtggcgaacgggtgagtaacacgtgggcaatctgccctgcactctgggacaagccctggaaacggggtctaataccggatatgagcctgggaggcatctcccgggttgtaaagctccggcggtgcaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcacgtcgattgtgaaagcccgaggcttaacctcgggtctgcagtcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaagcattagagatagtgccccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagttggtaacacccgaagccggtggcccaaccccttgtgggagggagctgtcgaaggtgggactagcgattgggacgaagtcgtaacaaggtagccgtaccggaaggtgcggctggatcacctcctttcta

SEQ ID NO: 9367 - DNA, 1531 bp, Streptomyces sp. 3212.5; identical to SEQ ID NO: 9366
  ref <308>: DATABASE ACCESSION NUMBER: NCBI ACCESSION: NZ_QXCZ01000001.1
  ref <309>: DATABASE ENTRY DATE: 2019-04-01
  ref <313>: RELEVANT RESIDUES IN SEQ ID NO: (1)..(1531)

SEQ ID NO: 9368 - DNA, 1531 bp, Streptomyces sp. 42
  ref <308>: DATABASE ACCESSION NUMBER: NCBI ACCESSION: NZ_RBIH01000001.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggataacacctgcccgggcatctgggtgggttaaaagctccggcggtgaaggatgagcccgcggcctatcagcttgttggtgaggtagtggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaacggccagagatggtcgcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggcaggtacaatgagctgcgaagccgtgaggcggagcgaatctcaaaaagcctgtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9369 - DNA, 1531 bp, Streptomyces sp. 57
  ref <308>: DATABASE ACCESSION NUMBER: NCBI ACCESSION: NZ_RCCZ01000001.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggataacactcctgcaggcatctgtgggggttaaaagctccggcggtgaaggatgagcccgcggcctatcagcttgttggtgaggtagtggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggtctgtcgcgtcggatgtgaaagcccggggcttaaccccgggtctgcattcgatacgggcagactagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaagcatcagagatggtgccccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggcaggtacaatgagctgcgaagccgcgaggcggagcgaatctcaaaaagcctgtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9370 - DNA, 1531 bp, Streptomyces sp. 62
  ref <308>: DATABASE ACCESSION NUMBER: NCBI ACCESSION: NZ_QREK01000001.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggatacgacccgccgaggcatctcggcgggtggaaagctccggcggtgaaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcatccgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcattagagatagtgccccccttgtggtcggtatacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaaagagctgcgatgccgtgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9371 - DNA, 1531 bp, Streptomyces sp. 67; identical to SEQ ID NO: 9366
  ref <308>: DATABASE ACCESSION NUMBER: NCBI ACCESSION: NZ_QREB01000001.1
  ref <309>: DATABASE ENTRY DATE: 2019-04-01
  ref <313>: RELEVANT RESIDUES IN SEQ ID NO: (1)..(1531)

SEQ ID NO: 9372 - DNA, 1531 bp, Streptomyces sp. 74; identical to SEQ ID NO: 9368
  ref <308>: DATABASE ACCESSION NUMBER: NCBI ACCESSION: NZ_RCCD01000001.1
  ref <309>: DATABASE ENTRY DATE: 2019-04-01
  ref <313>: RELEVANT RESIDUES IN SEQ ID NO: (1)..(1531)

SEQ ID NO: 9373 - DNA, 1529 bp, Streptomyces sp. 75
  ref <308>: DATABASE ACCESSION NUMBER: NCBI ACCESSION: NZ_QTTG01000001.1
  ref <309>: DATABASE ENTRY DATE: 2019-04-01
  ref <313>: RELEVANT RESIDUES IN SEQ ID NO: (1)..(1529)
cattcacggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggatatgaccatcttgggcatccttgatggtgtaaagctccggcggtgaaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaagcattagagatagtgccccccttgtggtcggtgtacaggtggtgcatggctgtcgtcagctcgtgtcgtgagatgttgggttaagtcccgcaacgagcgcaacccttgtcccgtgttgccagcaactcttcggaggttggggactcacgggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagttgctagtaatcgcagatcagcagtgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9374 - DNA, 1531 bp, Streptomyces sp. 840.1
  ref <308>: DATABASE ACCESSION NUMBER: NCBI ACCESSION: NZ_RJUU01000001.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggataatactttccctctcatgggggaaggttaaaagctccggcggtgaaggatgagcccgcggcctatcagctagttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgttgcgtcggttgtgaaagcccggggcttaaccccgggtctgcagtcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcatcagagatggtgccccccttgtggtcggtatacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgatgccgcgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9375 - DNA, 1531 bp, Streptomyces sp. 844.5
  ref <308>: DATABASE ACCESSION NUMBER: NCBI ACCESSION: NZ_RJKW01000001.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacggtgaagcccttcggggtggatcagtggcgaacgggtgagtaacacgtgggcaatctgccctgcattctgggacaagccttggaaacgaggtctaataccggatacgacgcatctccgcatggagtgtgcgtggaaagctccggcgatgcaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcaccggctaactacgtgccagcagccgcggtaatacgtagggtgcgagcgttgtccggatttattgggcgtaaagagctcgtaggcggcctgtcgcgtcggatgtgaaagcccggggcttaactccgggtctgcattcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgtgggtcacattccacgtggtccgcgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaacgtgcagagatgtacgcccccttgtggtcggtatacaggtggtgcatggttgtcgtcagctcgtgtcgtgagatgttgggttaagtcccgcaacgagcgcaaccctcgttctgtgttgccagcatgcctttcggggtgatggggactcacaggagactgccggggtcaactcggaggaaggtggggacgacgtcaaatcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcctaacccgcaagggaaggagctgtcgaaggtgggaccagcgattgggacgaagtcgtaacaaggtagccgtaccggaaggtgcggctggatcacctcctttcta

SEQ ID NO: 9376 - DNA, 1530 bp, Streptomyces sp. ADI95-16
  ref <308>: DATABASE ACCESSION NUMBER: NCBI ACCESSION: NZ_CP033581.1
  ref <309>: DATABASE ENTRY DATE: 2019-04-01
  ref <313>: RELEVANT RESIDUES IN SEQ ID NO: (1)..(1530)
cattcatggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggataccactcccgcccgcatgggtgggggttgaaagctccggcggtgaaggatgagcccgcggcctatcagcttgttggtggggtaatggcccaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccgaggcttaacctcgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatatactggaaagcattagagatagtgccccccttgtggtcggtatacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaacccgtaagggagggagctgtcgaaggtgggactggcgattgggacgaagtcgtaacaaggtagccgtaccggaaggtgcggctggatcacctcctttcta

SEQ ID NO: 9377 - DNA, 1238 bp, Streptomyces sp. AZ1-7
  ref <308>: DATABASE ACCESSION NUMBER: NCBI ACCESSION: NZ_RBDX01000071.1
  ref <309>: DATABASE ENTRY DATE: 2019-04-01
  ref <313>: RELEVANT RESIDUES IN SEQ ID NO: (1)..(1238)
cggccacactgggactgagacacggcccagactcctacgggaggcagcagtggggaatattgcacaatgggcggaagcctgatgcagcgacgccgcgtgagggatgacggccttcgggttgtaaacctctttcagcagggaagaagctccttggggtgacggtacctgtagaagaagcaccggctaactacgtgccagcagccgcggtaatacgtagggtgcgagcgttgtccggaattattgggcgtaaagagctcgtaggcggtttgtcgcgtcggttgtgaaagcccggggcttaaccctgggtctgcagtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacggtgggaactaggtgtgggcagcattccacgttgtctgtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatatgccggaaagccctggagacagggtgtctctttgagtcggtgtacaggtggtgcatggctgtcgtcagctcgtgtcgtgagatgttgggttaagtcccgcaacgagcgcaacccttgtcctgtgttgccagcaacattccttttggggtggttggggactcacgggagactgccggggtcaactcggaggaaggtggggacgacgtcaagtcatcatgccccttatgtcttgggctgcacacgtgctacaatggccggtacaatgagctgcgatgccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcctaaccccttgtgggagggagctgtcgaaggtgggactggcgattgggacgaagtcgtaacaaggtagccgtaccggaaggtgcggctggatcacctcctttcta

SEQ ID NO: 9378 - DNA, 1533 bp, Streptomyces sp. AcE210
  ref <308>: DATABASE ACCESSION NUMBER: NCBI ACCESSION: NZ_QURC01000004.1
  ref <309>: DATABASE ENTRY DATE: 2019-04-01
  ref <313>: RELEVANT RESIDUES IN SEQ ID NO: (1)..(1533)
cattcacggagagtttgatcctggctcaggacgaacgctggcggcgtgcttaacacatgcaagtcgaacgatgaagcccttcggggtggattagtggcgaacgggtgagtaacacgtgggcaatctgccctgcactctgggacaagccctggaaacggggtctaataccggataacaccccctctcgcatgggagggggttgaaagctccggcggtgcaggatgagcccgcggcctatcagcttgttggtgaggtagaagctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcatcagagatggtgccccccttgtggtcggtatacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggcaggtacaatgagctgcgatgccgcgaggcggagcgaatctcaaaaagcctgtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaacccccttgtggggagggagctgtcgaaggtgggactggcgattgggacgaagtcgtaacaaggtagccgtaccggaaggtgcggctggatcacctcctttcta

SEQ ID NO: 9379 - DNA, 1531 bp, Streptomyces sp. Ag109 G2-6; identical to SEQ ID NO: 9363
  ref <308>: DATABASE ACCESSION NUMBER: NCBI ACCESSION: NZ_RKRC01000001.1
  ref <309>: DATABASE ENTRY DATE: 2019-04-01
  ref <313>: RELEVANT RESIDUES IN SEQ ID NO: (1)..(1531)

SEQ ID NO: 9380 - DNA, 1529 bp, Streptomyces sp. Ag109 O5-1
  ref <308>: DATABASE ACCESSION NUMBER: NCBI ACCESSION: NZ_RKQF01000001.1
  ref <309>: DATABASE ENTRY DATE: 2019-04-01
  ref <313>: RELEVANT RESIDUES IN SEQ ID NO: (1)..(1529)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggataacactttcacgggcatctgtgagggttaaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcacgtcgattgtgaaagcccgaggcttaacctcgggtctgcagtcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaacgtctggagacaggcgcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccttgtggagggagctgtcgaaggtgggactggcgattgggacgaagtcgtaacaaggtagccgtaccggaaggtgcggctggatcacctcctttcta

SEQ ID NO: 9381 - DNA, 1538 bp, Streptomyces sp. Ag82 G5-5
  ref <308>: DATABASE ACCESSION NUMBER: NCBI ACCESSION: NZ_RKQI01000005.1
  ref <309>: DATABASE ENTRY DATE: 2019-04-01
  ref <313>: RELEVANT RESIDUES IN SEQ ID NO: (1)..(1538)
cattcacggagagtttgatcctggctcaggacgaacgctggcggcgtgcttaacacatgcaagtcgaacgatgaaccacttcggtggggattagtggcgaacgggtgagtaacacgtgggtaatctgcccttcactctgggacaagccctggaaacggggtctaataccggatatcacttccactcgcatgggtgggggttgaaagctccggcggtgaaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatcgcccggaaagcatcagagatggtgccccccttgtggtcgggtgacaggtggtgcatggctgtcgtcagctcgtgtcgtgagatgttgggttaagtcccgcaacgagcgcaacccttgttctgtgttgccagcatgcccttcggggtgatggggactcacaggagaccgccggggtcaactcggaggaaggtggggacgaacgtcaagtcatcatgccccttatgtcttgggctgcacacgtgctacaatggccggtacaatgaagctgcgatacccgtgaggtgggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaacccccttgtggggagggagctgtcgaaggtgggactggcgattgggacgaagtcgtaacaagggtagccgtaccggaaggtgcggctggatcacctcctttcta

SEQ ID NO: 9382 - DNA, 1531 bp, Streptomyces sp. Ag82 O1-9
  ref <308>: DATABASE ACCESSION NUMBER: NCBI ACCESSION: NZ_QTUG01000001.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggatacgagcctccaaggcatcttgggggttggaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgattgtgaaagcccgaggcttaacctcgggtctgcagtcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaagcattagagatagtgccccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaaagagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagttggtaacacccgaagccggtggcccaaccccttgtgggagggagctgtcgaaggtgggactagcgattgggacgaagtcgtaacaaggtagccgtaccggaaggtgcggctggatcacctcctttcta

SEQ ID NO: 9383 - DNA, 1533 bp, Streptomyces sp. B27
  ref <308>: DATABASE ACCESSION NUMBER: NCBI ACCESSION: NZ_RHJB01000053.1
  ref <309>: DATABASE ENTRY DATE: 2019-04-01
  ref <313>: RELEVANT RESIDUES IN SEQ ID NO: (1)..(1533)
cattcacggagagtttgatcctggctcaggacgaacgctggcggcgtgcttaacacatgcaagtcgaacgatgaagccgcttcggtggtggattagtggcgaacgggtgagtaacacgtgggcaatctgcccttcactctgggacaagccctggaaacggggtctaataccggataatactcctgcctgcatgggtgggggttgaaagctccggcggtgaaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcatcagagatggtgccccccttgtggtcggtatacaggtggtgcatggctgtcgtcagctcgtgtcgtgagatgttgggttaagtcccgcaacgagcgcaacccttgttctgtgttgccagcatgcctttcggggtgatggggactcacaggagactgccggggtcaactcggaggaaggtggggacgacgtcaagtcatcatgccccttatgtcttgggctgcacacgtgctacaatggccggtacaatgagctgcgatgccgtgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9384 - DNA, 1531 bp, Streptomyces sp. B29 2018
  ref <308>: DATABASE ACCESSION NUMBER: NCBI ACCESSION: NZ_RHJC01000035.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaaccgctttcgggcggggattagtggcgaacgggtgagtaacacgtgggcaatctgccctgcactctgggacaagccctggaaacggggtctaataccggatatgactgtccatcgcatggtggatggtgtaaagctccggcggtgcaggatgagcccgcggcctatcagcttgttggtgaggtagtggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaacgtctggagacaggcgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttct

SEQ ID NO: 9385 - DNA, 1530 bp, Streptomyces sp. BSE7F
  ref <308>: DATABASE ACCESSION NUMBER: NCBI ACCESSION: NZ_QEQV01000005.1
  ref <309>: DATABASE ENTRY DATE: 2019-04-01
  ref <313>: RELEVANT RESIDUES IN SEQ ID NO: (1)..(1530)
cattcacggagagtttgatcctggctcaggacgaacgctggcggcgtgcttaacacatgcaagtcgaacgatgaaccacttcggtggggattagtggcgaacgggtgagtaacacgtgggcaatctgccctgcactctgggacaagccctggaaacggggtctaataccggatactgatcatcttgggcatcttggatgatcgaaagctccggcggtgcaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcgagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcgacattccacgtcgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaagcatcagagatggtgccccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttct

SEQ ID NO: 9386 - DNA, 1532 bp, Streptomyces sp. CB09001
  ref <308>: DATABASE ACCESSION NUMBER: NCBI ACCESSION: NZ_CP026730.1
  ref <309>: DATABASE ENTRY DATE: 2019-04-01
  ref <313>: RELEVANT RESIDUES IN SEQ ID NO: (1)..(1532)
cattcacggagagtttgatcctggctcaggacgaacgctggcggcgtgcttaacacatgcaagtcgaacgatgaaccacttcggtggggattagtggcgaacgggtgagtaacacgtgggcaatctgccctgcactctgggacaagccctggaaacggggtctaataccggatactgaccctcgcgggcatctgcgaggttcgaaagctccggcggtgcaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaagcatcagagatggtgccccccttgtggtcggtgtacaggtggtgcatggctgtcgtcagctcgtgtcgtgagatgttgggttaagtcccgcaacgagcgcaacccttgtcccgtgttgccagcaagcccttcggggtgttggggactcacgggagaccgccggggtcaactcggaggaaggtggggacgacgtcaagtcatcatgccccttatgtcttgggctgcacacgtgctacaatggccggtacaatgagctgcgataccgcaaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9387 - DNA, 1533 bp, Streptomyces sp. CC0208
  ref <308>: DATABASE ACCESSION NUMBER: NCBI ACCESSION: NZ_CP031969.1
  ref <309>: DATABASE ENTRY DATE: 2019-04-01
  ref <313>: RELEVANT RESIDUES IN SEQ ID NO: (1)..(1533)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggataccactcgcacgggcatctgtgcgggttgaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaagcatcagagatggtgccccccttgtggtcggtgtacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggcaggtacaatgagctgcgataccgtgaggtggagcgaatctcaaaaagcctgtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaacccccttgtggggagggagctgtcgaaggtgggactggcgattgggacgaagtcgtaacaaggtagccgtaccggaaggtgcggctggatcacctcctttcta

SEQ ID NO: 9388 - DNA, 1531 bp, Streptomyces sp. CCM MD2014
  ref <308>: DATABASE ACCESSION NUMBER: NCBI ACCESSION: NZ_CP009754.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaaccaccttcgggtggggattagtggcgaacgggtgagtaacacgtgggcaatctgccctgcactctgggacaagccctggaaacggggtctaataccggatactgacccgccaaggcatcttggcgggtcgaaagctccggcggtgcaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcgcgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaagcatcagagatggtgccccccttgtggtcggtgtacaggtggtgcatggctgtcgtcagctcgtgtcgtgagatgttgggttaagtcccgcaacgagcgcaacccttgtcccgtgttgccagcaactcttcggaggttggggactcacgggagaccgccggggtcaactcggaggaaggtggggacgacgtcaagtcatcatgccccttatgtcttgggctgcacacgtgctacaatggccggtacaatgagctgcgataccgcaaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttct

SEQ ID NO: 9389 - DNA, 1531 bp, Streptomyces sp. CEV 2-1
  ref <308>: DATABASE ACCESSION NUMBER: NCBI ACCESSION: NZ_RJUV01000001.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggataatactttccctctcatgggggaaggttaaaagctccggcggtgaaggatgagcccgcggcctatcagctagttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgttgcgtcggttgtgaaagcccggggcttaaccccgggtctgcagtcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaagcatcagagatggtgccccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgatgccgcgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9390 - DNA, 1537 bp, Streptomyces sp. CNQ-509
  ref <308>: DATABASE ACCESSION NUMBER: NCBI ACCESSION: NZ_CP011492.1
  ref <309>: DATABASE ENTRY DATE: 2019-04-01
  ref <313>: RELEVANT RESIDUES IN SEQ ID NO: (1)..(1537)
catttacggagagtttgatcctggctcaggacgaacgctggcggcgtgcttaacacatgcaagtcgaacgatgatccggtttcggccggggattagtggcgaacgggtgagtaacacgtgggcaatctgccctgcactctgggacaagccctggaaacggggtctaataccggatagtaccttcgggcgcatgcctgttggtggaaagctccggcggtgcaggatgggcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcgcgtcggatgtgaaagcccggggcttaaccccgggtctgcattcgatacgggcaggctggagttcggtaggggagatcggaattcctggtgtagcggtggaatgcgcagatatcaggaggaacaccggtggcgaaggcggatctctgggccgatactgacgctgaggagcgaaagcgtggggagcaaacaggattagataccctggtagtccacgccgtaaacggtgggcactaggtgtgggcggcattccacgtcgtccgtgccgtagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaacatccagagagtgggtcgcccccttgtggtcggtgtacaggtggtgcatggctgtcgtcagctcgtgtcgtgagatgttgggttaagtcccgcaacgagcgcaacccttgtcctgtgttgccagcacgctccttcgggggtggtggggactcacgggagactgccggggtcaactcggaggaaggtggggacgacgtcaagtcatcatgccccttatgtcttgggctgcacacgtgctacaatggccggtacaatgagctgcgataccgcaaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagccgtcgaaggtgggactggcgattgggacgaagtcgtaacaaggtagccgtaccggaaggtgcggctggatcacctcctttcta

SEQ ID NO: 9391 - DNA, 1238 bp, Streptomyces sp. DS1-2; identical to SEQ ID NO: 9377
  ref <308>: DATABASE ACCESSION NUMBER: NCBI ACCESSION: NZ_RBDY01000069.1
  ref <309>: DATABASE ENTRY DATE: 2019-04-01
  ref <313>: RELEVANT RESIDUES IN SEQ ID NO: (1)..(1238)

SEQ ID NO: 9392 - DNA, 1533 bp, Streptomyces sp. DUT11
  ref <308>: DATABASE ACCESSION NUMBER: NCBI ACCESSION: NZ_CP025511.1
  ref <309>: DATABASE ENTRY DATE: 2019-04-01
  ref <313>: RELEVANT RESIDUES IN SEQ ID NO: (1)..(1533)
cattcacggagagtttgatcctggctcaggacgaacgctggcggcgtgcttaacacatgcaagtcgaacgatgaagccgcttcggtggtggattagtggcgaacgggtgagtaacacgtgggcaatctgcccttcactctgggacaagccctggaaacggggtctaataccggataatactctgttccgcatggaacggggttgaaagctccggcggtgaaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcatcagagatggtgccccccttgtggtcggtatacaggtggtgcatggctgtcgtcagctcgtgtcgtgagatgttgggttaagtcccgcaacgagcgcaacccttgttctgtgttgccagcatgcctttcggggtgatggggactcacaggagactgccggggtcaactcggaggaaggtggggacgacgtcaagtcatcatgccccttatgtcttgggctgcacacgtgctacaatggccggtacaatgagctgcgatgccgtgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9393 - DNA, 1529 bp, Streptomyces sp. DvalAA-14
  ref <308>: DATABASE ACCESSION NUMBER: NCBI ACCESSION: NZ_FMCH01000380.1
  ref <309>: DATABASE ENTRY DATE: 2019-04-01
  ref <313>: RELEVANT RESIDUES IN SEQ ID NO: (1)..(1529)
cattcacggagagtttgatcctggctcaggacgaacgctggcggcgtgcttaacacatgcaagtcgaacggtgaagccttcgggtggatcagtggcgaacgggtgagtaacacgtgggcaatctgccctgcactctgggacaagccctggaaacggggtctaataccggatattacctgggagggcatcttcccgggtgtaaagctccggcggtgcaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcaccggctaactacgtgccagcagccgcggtaatacgtagggtgcgagcgttgtccggaattattgggcgtaaagagctcgtaggcggtttgtcgcgtcggatgtgaaagcccggggcttaaccccgggtctgcattcgatacgggcagactagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacatcagaaaaccgtagagatacggtcccccttgtggctggtgtacaggtggtgcatggctgtcgtcagctcgtgtcgtgagatgttgggttaagtcccgcaacgagcgcaacccctgttctgtgttgccagcatgcctttcggggtgatggggactcacaggagaccgccggggtcaactcggaggaaggtggggacgacgtcaagtcatcatgccccttatgtcttgggctgcacacgtgctacaatggccggtacaatgagctgcgatgccgtgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9394 - DNA, 1532 bp, Streptomyces sp. E1N211
  ref <308>: DATABASE ACCESSION NUMBER: NCBI ACCESSION: NZ_RAII01000001.1
  ref <309>: DATABASE ENTRY DATE: 2019-04-01
  ref <313>: RELEVANT RESIDUES IN SEQ ID NO: (1)..(1532)
cattcacggagagtttgatcctggctcaggacgaacgctggcggcgtgcttaacacatgcaagtcgaacgatgaacctccttcgggaggggattagtggcgaacgggtgagtaacacgtgggcaatctgccctgcactctgggacaagccctggaaacggggtctaataccggatactgacccgcttgggcatccaagcggttcgaaagctccggcggtgcaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcgagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcgacattccacgtcgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaagcatcagagatggtgccccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttct

SEQ ID NO: 9395 - DNA, 1532 bp, Streptomyces sp. E2N166
  ref <308>: DATABASE ACCESSION NUMBER: NCBI ACCESSION: NZ_RAIF01000009.1
  ref <309>: DATABASE ENTRY DATE: 2019-04-01
  ref <313>: RELEVANT RESIDUES IN SEQ ID NO: (1)..(1532)
cattcacggagagtttgatcctggctcaggacgaacgctggcggcgtgcttaacacatgcaagtcgaacgatgaaccacttcggtggggattagtggcgaacgggtgagtaacacgtgggcaatctgccctgcactctgggacaagccctggaaacggggtctaataccggatactgacccgcttgggcatccaagcggttcgaaagctccggcggtgcaggatgagcccgcggcctatcagctagttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaagcatcagagatggtgccccccttgtggtcggtgtacaggtggtgcatggctgtcgtcagctcgtgtcgtgagatgttgggttaagtcccgcaacgagcgcaacccttgtcccgtgttgccagcaagcccttcggggtgttggggactcacgggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9396 - DNA, 1532 bp, Streptomyces sp. E2N171; identical to SEQ ID NO: 9394
  ref <308>: DATABASE ACCESSION NUMBER: NCBI ACCESSION: NZ_RAIH01000271.1
  ref <309>: DATABASE ENTRY DATE: 2019-04-01
  ref <313>: RELEVANT RESIDUES IN SEQ ID NO: (1)..(1532)

SEQ ID NO: 9397 - DNA, 1531 bp, Streptomyces sp. E5N298
  ref <308>: DATABASE ACCESSION NUMBER: NCBI ACCESSION: NZ_RAIG01000222.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaaccacttcggtggggattagtggcgaacgggtgagtaacacgtgggcaatctgccctgcactctgggacaagccctggaaacggggtctaataccggatactgatccgcctgggcatccaggcggttcgaaagctccggcggtgcaggatgagcccgcggcctatcagcttgttggtgaggtagtggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaagcatcagagatggtgccccccttgtggtcggtgtacaggtggtgcatggctgtcgtcagctcgtgtcgtgagatgttgggttaagtcccgcaacgagcgcaacccttgtcccgtgttgccagcaagcccttcggggtgttggggactcacgggagaccgccggggtcaactcggaggaaggtggggacgacgtcaagtcatcatgccccttatgtcttgggctgcacacgtgctacaatggccggtacaatgagctgcgataccgcaaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttct

SEQ ID NO: 9398 - DNA, 1531 bp, Streptomyces sp. E5N91 SAI-083; identical to SEQ ID NO: 9397
  ref <308>: DATABASE ACCESSION NUMBER: NCBI ACCESSION: NZ_RJKF01000001.1
  ref <309>: DATABASE ENTRY DATE: 2019-04-01
  ref <313>: RELEVANT RESIDUES IN SEQ ID NO: (1)..(1531)

SEQ ID NO: 9399 - DNA, 1532 bp, Streptomyces sp. F001
  ref <308>: DATABASE ACCESSION NUMBER: NCBI ACCESSION: NZ_QZWF01000001.1
  ref <309>: DATABASE ENTRY DATE: 2019-04-01
  ref <313>: RELEVANT RESIDUES IN SEQ ID NO: (1)..(1532)
cattcacggagagtttgatcctggctcaggacgaacgctggcggcgtgcttaacacatgcaagtcgaacgatgaagccctccggggtggattagtggcgaacgggtgagtaacacgtgggcaatctgcccttcactctgggacaagccctggaaacggggtctaataccggatacgaccatcttgggcatctttgatggtggaaagctccggcggtgaaggatgggcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcggaagaaccttaccaaggcttgacatacaccggaaacgtctggagacaggcgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagtcgctagtaatcgcagatcagcagtgctgcggtgaatacgttcccgggccttgtacacaccgcccgtcacgtcacgaaagtcggtaacacccgaagccggtggcccaacccgttcgcgggagggagctgtcgaaggtgggactggcgattgggacgaagtcgtaacaaggtagccgtaccggaaggtgcggctggatcacctcctttcta

SEQ ID NO: 9400 - DNA, 1526 bp, Streptomyces sp. GKU 895
  ref <308>: DATABASE ACCESSION NUMBER: NCBI ACCESSION: NZ_MWJO01000121.1
  ref <309>: DATABASE ENTRY DATE: 2019-04-01
  ref <313>: RELEVANT RESIDUES IN SEQ ID NO: (1)..(1526)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggataccacttccactcgcatgggtggaggttgaaagctccggcggtgaaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaagcattagagatagtgcccccttgtggtcggtgtacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggcaggtacaatgagctgcgaaaccgtgaggtggagcgaatctcaaaaagcctgtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggaccagcgattgggacgaagtcgtaacaaggtagccgtaccggaaggtgcggctggatcacctcctt

SEQ ID NO: 9401 - DNA, 1534 bp, Streptomyces sp. GZWMJZ-114
  ref <308>: DATABASE ACCESSION NUMBER: NCBI ACCESSION: NZ_RWGV01000034.1
  ref <309>: DATABASE ENTRY DATE: 2019-04-01
  ref <313>: RELEVANT RESIDUES IN SEQ ID NO: (1)..(1534)
cattcacggagagtttgatcctggctcaggacgaacgctggcggcgtgcttaacacatgcaagtcgaacgatgaaccgctttcgggcggggattagtggcgaacgggtgagtaacacgtgggcaatctgccctgcactctgggacaagccctggaaacggggtctaataccggatactcactgccttgggcatccttggtggtggaaagctccggcggtgcaggatgagcccgcggcctatcagctagttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcagcggagcatgtggcttaattcgacgcaacgcgaagaaccttaccaaggcttgacatacaccggaaagcattagagatagtgccccccttgtggtcggtgtacaggtggtgcatggctgtcgtcagctcgtgtcgtgagatgttgggttaagtcccgcaacgagcgcaacccttgtcccgtgttgccagcaagcccttcggggtgttggggactcacgggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggaccagcgattgggacgaagtcgtaacaaggtagccgtaccggaaggtgcggctggatcacctcctttcta

SEQ ID NO: 9402 - DNA, 1531 bp, Streptomyces sp. HB202; identical to SEQ ID NO: 9330
  ref <308>: DATABASE ACCESSION NUMBER: NCBI ACCESSION: NZ_QRAT01000001.1
  ref <309>: DATABASE ENTRY DATE: 2019-04-01
  ref <313>: RELEVANT RESIDUES IN SEQ ID NO: (1)..(1531)

SEQ ID NO: 9403 - DNA, 1523 bp, Streptomyces sp. I6
  ref <308>: DATABASE ACCESSION NUMBER: NCBI ACCESSION: NZ_RHDP01000001.1
  ref <309>: DATABASE ENTRY DATE: 2019-04-01
  ref <313>: RELEVANT RESIDUES IN SEQ ID NO: (1)..(1523)
cattcacggagagtttgatcctggctcaggacgaacgctggcggcgtgcttaacacatgcaagtcgaacgatgaacctctttcgggaggggattagtggcgaacgggtgagtaacacgtgggcaatctgccctgcactctgggacaagccctggaaacggggtctaataccggatatgaccatcgggggcatccctggtggtggaaagctccggcggtgcaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggaagaagcgtgagtgacggtacctgcagaagaagcgccggctaactacgtgccagcagccgcggtaatacgtagggcgcgagcgttgtccggaattattgggcgtaaagagctcgtaggcggcttgtcgcgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggcactaggtgtgggcgacattccacgtcgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatgcaccggaaagcatcagagatggtgccccccttgtggtcggtgtacaggtggtgcatggctgtcgtcagctcgtgtcgtgagatgttgggttaagtcccgcaacgagcgcaacccctgtcctgtgttgccagcgggtcatgccggggactcacaggagaccgccggggtcaactcggaggaaggtggggacgacgtcaagtcatcatgccccttatgtcttgggctgcacacgtgctacaatggccggtacaatgagctgcgatgccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccttgggagggagccgtcgaaggtgggactggcgattgggacgaagtcgtaacaaggtagccgtaccggaaggtgcggctggatcacctcctttcta

SEQ ID NO: 9404 - DNA, 1531 bp, Streptomyces sp. IB2014 011-12
  ref <308>: DATABASE ACCESSION NUMBER: NCBI ACCESSION: NZ_QEIK01000044.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaagcctttcggggtggattagtggcgaacgggtgagtaacacgtgggcaatctgcccttcactctgggacaagccctggaaacggggtctaataccggataacactctgtcccgcatgggacggggttaaaagctccggcggtgaaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcatcagagatggtgccccccttgtggtcggtatacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgatgccgcgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9405 - DNA, 1531 bp, Streptomyces sp. IgraMP-1; identical to SEQ ID NO: 9384
  ref <308>: DATABASE ACCESSION NUMBER: NCBI ACCESSION: NZ_FMCM01000037.1
  ref <309>: DATABASE ENTRY DATE: 2019-04-01
  ref <313>: RELEVANT RESIDUES IN SEQ ID NO: (1)..(1531)

SEQ ID NO: 9406 - DNA, 1531 bp, Streptomyces sp. KPB2
  ref <308>: DATABASE ACCESSION NUMBER: NCBI ACCESSION: NZ_CP034353.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaaccaccttcgggtggggattagtggcgaacgggtgagtaacacgtgggcaatctgccctgcactctgggacaagccctggaaacggggtctaataccggatactgacctgccagggcatcttggcgggtcgaaagctccggcggtgcaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcgcgtcggttgtgaaagcccggggcttaactccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaagcatcagagatggtgccccccttgtggtcggtgtacaggtggtgcatggctgtcgtcagctcgtgtcgtgagatgttgggttaagtcccgcaacgagcgcaacccttgtcccgtgttgccagcaactcttcggaggttggggactcacgggagaccgccggggtcaactcggaggaaggtggggacgacgtcaagtcatcatgccccttatgtcttgggctgcacacgtgctacaatggccggtacaatgagctgcgataccgcaaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttct

SEQ ID NO: 9407 - DNA, 1531 bp, Streptomyces sp. L-9-10
  ref <308>: DATABASE ACCESSION NUMBER: NCBI ACCESSION: NZ_PHRF01000044.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaagcctttcggggtggattagtggcgaacgggtgagtaacacgtgggcaatctgcccttcactctgggacaagccctggaaacggggtctaataccggataatacttctgcctgcatgggcgggggttgaaagctccggcggtgaaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcgcgtcggatgtgaaagcccggggcttaaccccgggtctgcattcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaacggccagagatggtcgcccccttgtggtcggtgtacaggtggtgcatggctgtcgtcagctcgtgtcgtgagatgttgggttaagtcccgcaacgagcgcaacccttgttctgtgttgccagcatgcctttcggggtgatggggactcacaggagactgccggggtcaactcggaggaaggtggggacgacgtcaagtcatcatgccccttatgtcttgggctgcacacgtgctacaatggccggtacaatgagctgcgatgccgtgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9408 - DNA, 1533 bp, Streptomyces sp. L2
  ref <308>: DATABASE ACCESSION NUMBER: NCBI ACCESSION: NZ_QBDT01000001.1
  ref <309>: DATABASE ENTRY DATE: 2019-04-01
  ref <313>: RELEVANT RESIDUES IN SEQ ID NO: (1)..(1533)
cattcacggagagtttgatcctggctcaggacgaacgctggcggcgtgcttaacacatgcaagtcgaacgatgaacctccttcgggaggggattagtggcgaacgggtgagtaacacgtgggcaatctgcccttcactctgggacaagccctggaaacggggtctaataccggatacgaggttcggaggcatcttcgaacttggaaagctccggcggtgaaggatgagcccgcggcctatcagcttgttggtgaggtagtggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgattgtgaaagcccgaggcttaacctcgggtctgcagtcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatataccggaaacatccagagatgggtgcccccttgtggtcggtatacaggtggtgcatggctgtcgtcagctcgtgtcgtgagatgttgggttaagtcccgcaacgagcgcaacccttgttctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9409 - DNA, 1532 bp, Streptomyces sp. M2
  ref <308>: DATABASE ACCESSION NUMBER: NCBI ACCESSION: NZ_CP028834.1
  ref <309>: DATABASE ENTRY DATE: 2019-04-01
  ref <313>: RELEVANT RESIDUES IN SEQ ID NO: (1)..(1532)
cattcacggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggatacgacgcgctcgggcatccgatgtgcgtggaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcacgtcgattgtgaaagcccgaggcttaacctcgggtctgcagtcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaacatccagagatgggtgcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagtcgctagtaatcgcagatcagcagtgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9410 - DNA, 1531 bp, Streptomyces sp. M3
  ref <308>: DATABASE ACCESSION NUMBER: NCBI ACCESSION: NZ_QANR01000003.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggataacactctgtcccgcatgggacggggttaaaagctccggcggtgaaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcatcagagatggtgccccccttgtggtcggtatacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgatgccgcgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9411 - DNA, 1532 bp, Streptomyces sp. MG; identical to SEQ ID NO: 9409
  ref <308>: DATABASE ACCESSION NUMBER: NCBI ACCESSION: NZ_QANQ01000002.1
  ref <309>: DATABASE ENTRY DATE: 2019-04-01
  ref <313>: RELEVANT RESIDUES IN SEQ ID NO: (1)..(1532)

SEQ ID NO: 9412 - DNA, 1531 bp, Streptomyces sp. MK45
  ref <308>: DATABASE ACCESSION NUMBER: NCBI ACCESSION: NZ_CP034539.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggataccactctcgcaggcatctgtgagggttgaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaacggccagagatggtcgcccccttgtggtcggtgtacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaatgagctgcgaaaccgtgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9413 - DNA, 1533 bp, Streptomyces sp. MnatMP-M17
  ref <308>: DATABASE ACCESSION NUMBER: NCBI ACCESSION: NZ_FMDK01000146.1
  ref <309>: DATABASE ENTRY DATE: 2019-04-01
  ref <313>: RELEVANT RESIDUES IN SEQ ID NO: (1)..(1533)
cattcacggagagtttgatcctggctcaggacgaacgctggcggcgtgcttaacacatgcaagtcgaacgatgaagccttcgggtggattagtggcgaacgggtgagtaacacgtgggcaatctgcccttcactctgggacaagccctggaaacggggtctaataccggataatactttctcctgcatgggggagggttgaaagctccggcggtgaaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggaagaagcgtgagtgacggtacctgcagaagaagcgccggctaactacgtgccagcagccgcggtaatacgtagggcgcaagcgttgtccggaattattgggcgtaaagagctcgtaggcggcttgtcgcgtcggatgtgaaagcccggggcttaactccgggtctgcattcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaactggcagagatgtcagcccccttgtggtcggtgtacaggtggtgcatggctgtcgtcagctcgtgtcgtgagatgttgggttaagtcccgcaacgagcgcaacccttgttctgtgttgccagcatgccctttcgggggtgatggggactcacaggagactgccggggtcaactcggaggaaggtggggacgacgtcaagtcatcatgccccttatgtcttgggctgcacacgtgctacaatggccggtacaatgagctgcgatgccgtgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaacccccttgtggggagggagctgtcgaaggtgggactggcgattgggacgaagtcgtaacaaggtagccgtaccggaaggtgcggctggatcacctcctttcta

SEQ ID NO: 9414 - DNA, 1531 bp, Streptomyces sp. N1; identical to SEQ ID NO: 9384
  ref <308>: DATABASE ACCESSION NUMBER: NCBI ACCESSION: NZ_QBDS01000001.1
  ref <309>: DATABASE ENTRY DATE: 2019-04-01
  ref <313>: RELEVANT RESIDUES IN SEQ ID NO: (1)..(1531)

SEQ ID NO: 9415 - DNA, 1532 bp, Streptomyces sp. NEAU-D10
  ref <308>: DATABASE ACCESSION NUMBER: NCBI ACCESSION: NZ_QUAC01000041.1
  ref <309>: DATABASE ENTRY DATE: 2019-04-01
  ref <313>: RELEVANT RESIDUES IN SEQ ID NO: (1)..(1532)
cattcacggagagtttgatcctggctcaggacgaacgctggcggcgtgcttaacacatgcaagtcgaacgatgaagcctttcggggtggattagtggcgaacgggtgagtaacacgtgggcaatctgcccttcactctgggacaagccctggaaacggggtctaataccggatatgacacacgaccgcatggtctgtgtgtggaaagctccggcggtgaaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacgccggaaaaccctggagacagggtcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggaatcgtcgaaggtgggactggcgattgggacgaagtcgtaacaaggtagccgtaccggaaggtgcggctggatcacctcctttcta

SEQ ID NO: 9416 - DNA, 1534 bp, Streptomyces sp. NEAU-LD23
  ref <308>: DATABASE ACCESSION NUMBER: NCBI ACCESSION: NZ_RIBZ01000493.1
  ref <309>: DATABASE ENTRY DATE: 2019-04-01
  ref <313>: RELEVANT RESIDUES IN SEQ ID NO: (1)..(1534)
cattcacggagagtttgatcctggctcaggacgaacgctggcggcgtgcttaacacatgcaagtcgaacgatgaacccgcttcggtgggggattagtggcgaacgggtgagtaacacgtgggcaatctgccctgcactctgggacaagccctggaaacggggtctaataccggatatgatcaccggccgcatggtctggtgatggaaagctccggcggtgcaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcctgtcgcgtcggatgtgaaagcccggggcttaaccccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgttgtccgtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaacgtctggagacaggcgcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgaagccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggaatcgtcgaaggtgggactggcgattgggacgaagtcgtaacaaggtagccgtaccggaaggtgcggctggatcacctcctttcta

SEQ ID NO: 9417 - DNA, 1534 bp, Streptomyces sp. NEAU-SSA 1
  ref <308>: DATABASE ACCESSION NUMBER: NCBI ACCESSION: NZ_QXMJ01000235.1
  ref <309>: DATABASE ENTRY DATE: 2019-04-01
  ref <313>: RELEVANT RESIDUES IN SEQ ID NO: (1)..(1534)
cattcacggagagtttgatcctggctcaggacgaacgctggcggcgtgcttaacacatgcaagtcgaacgatgaagcccttcggggtggattagtggcgaacgggtgagtaacacgtgggcaatctgccctccactctgggacaagccctggaaacggggtctaataccggatacgaccatcggccgcatggcctggtggtggaaagctccggcggtggaggatgagcccgcggcctatcagctggttggtgaggtgatggctcaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcagcggagcatgtggcttaattcgacgcaacgcgaagaaccttaccaaggcttgacatacgccggaaagcatcagagatggtgccccccttgtggtcggtgtacaggtggtgcatggctgtcgtcagctcgtgtcgtgagatgttgggttaagtcccgcaacgagcgcaacccttgtcccgtgttgccagcaactccttcgggaggttggggactcacgggagaccgccggggtcaactcggaggaaggtggggacgacgtcaagtcatcatgccccttatgtcttgggctgcacacgtgctacaatggccggtacaatgagctgcgataccgcaaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaacccccttgtggggagggagctgtcgaaggtgggactggcgattgggacgaagtcgtaacaaggtagccgtaccggaaggtgcggctggatcacctcctttcta

SEQ ID NO: 9418 - DNA, 1532 bp, Streptomyces sp. NEAU-YY421
  ref <308>: DATABASE ACCESSION NUMBER: NCBI ACCESSION: NZ_QUAK01000006.1
  ref <309>: DATABASE ENTRY DATE: 2019-04-01
  ref <313>: RELEVANT RESIDUES IN SEQ ID NO: (1)..(1532)
cattcacggagagtttgatcctggctcaggacgaacgctggcggcgtgcttaacacatgcaagtcgaacgatgaacccgcttcggtgggggattagtggcgaacgggtgagtaacacgtgggcaatctgccctccactctgggacaagccctggaaacggggtctaataccggatacgacacagggccgcatggtctctgtgtggaaagctccggcggtggaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggaagaagcgtgagtgacggtacctgcagaagaagcgccggctaactacgtgccagcagccgcggtaatacgtagggcgcaagcgttgtccggaattattgggcgtaaagagctcgtaggcggcttgtcgcgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaaaccctggagacagggtcccccttgtggtcggtgtacaggtggtgcatggctgtcgtcagctcgtgtcgtgagatgttgggttaagtcccgcaacgagcgcaacccttgtcccgtgttgccagcaacttcttcggaaggttggggactcacgggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccctcggggagggagctgtcgaaggtgggaccagcgattgggacgaagtcgtaacaaggtagccgtaccggaaggtgcggctggatcacctcctttct

SEQ ID NO: 9419 - DNA, 1548 bp, Streptomyces sp. NEAU-YY642
  ref <308>: DATABASE ACCESSION NUMBER: NCBI ACCESSION: NZ_RFFJ01000294.1
  ref <309>: DATABASE ENTRY DATE: 2019-04-01
  ref <313>: RELEVANT RESIDUES IN SEQ ID NO: (1)..(1548)
ttcacggagagtttgatcctggctcaggacgaacgctggcggcgtgcttaacacatgcaagtcgaacgatgatccggcttcggtcggggattagtggcgaacgggtgagtaacacgtgggtaatctgccctgcactttgggataagcctgggaaactgggtctaataccggatatgaccttcttccgcatgggggttggtggaaagcttttgcggtgcaggatgggcccgcggcctatcagcttgttggtggggtagtggcctaccaaggcgacgacgggtagccggcctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcagcagggaagaagccttgcctttttgggtgggtgacggtacttgcagaagaagcaccggctaactacgtgccagcagccgcggtaatacgtagggtgcgagcgttgtccggatttattgggcgtaaagagctcgtaggcggcttgtcgcgtcggttgtgaaagctcggggcttaaccctgggtctgcagtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacggtgggaactaggtgtgggcagcattccacgttgtctgtgccgtagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacgccggaaactgctggagacagtagccctctttgagtcggtgtacaggtggtgcatggctgtcgtcagctcgtgtcgtgagatgttgggttaagtcccgcaacgagcgcaacccttgtcctgtgttgccagcgtgccctttcgggggtgacggggactcacgggagactgccggggtcaactcggaggaaggtggggacgacgtcaagtcatcatgccccttatgtcttgggctgcacacgtgctacaatggctggtacaatgagctgcgatgccgtgaggtggagcgaatctcaaaaagccagtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcctaacccccttgtggggagggagtcgtcgaaggtgggactggcgattgggacgaagtcgtaacaaggtagccgtaccggaaggtgcggctggatcacctcctttcta

SEQ ID NO: 9420 - DNA, 1420 bp, Streptomyces sp. NL15-2K
  ref <308>: DATABASE ACCESSION NUMBER: NCBI ACCESSION: NZ_BHXA01000127.1
  ref <309>: DATABASE ENTRY DATE: 2019-04-01
  ref <313>: RELEVANT RESIDUES IN SEQ ID NO: (1)..(1420)
agtcgaacgatgaaccacttcggtggggattagtggcgaacgggtgagtaacacgtgggcaatctgcccttcactctgggacaagccctggaaacggggtctaataccggatagcactctcgtgggcatctgcgagggttgaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaacgtccagagatgggcgcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaacccccttgtggggagggagctgtcgaaggtgggactggcgattgggacgaa

SEQ ID NO: 9421 - DNA, 1531 bp, Streptomyces sp. NP10; identical to SEQ ID NO: 9330
  ref <308>: DATABASE ACCESSION NUMBER: NCBI ACCESSION: NZ_PDIQ01000033.1
  ref <309>: DATABASE ENTRY DATE: 2019-04-01
  ref <313>: RELEVANT RESIDUES IN SEQ ID NO: (1)..(1531)

SEQ ID NO: 9422 - DNA, 1531 bp, Streptomyces sp. NRRL F-3307; identical to SEQ ID NO: 9324
  ref <308>: DATABASE ACCESSION NUMBER: NCBI ACCESSION: NZ_JOIC01000117.1
  ref <309>: DATABASE ENTRY DATE: 2019-04-01
  ref <313>: RELEVANT RESIDUES IN SEQ ID NO: (1)..(1531)

SEQ ID NO: 9423 - DNA, 1529 bp, Streptomyces sp. NRRL F-5122
  ref <308>: DATABASE ACCESSION NUMBER: NCBI ACCESSION: NZ_LMWH01000003.1
  ref <309>: DATABASE ENTRY DATE: 2019-04-01
  ref <313>: RELEVANT RESIDUES IN SEQ ID NO: (1)..(1529)
cattcacggagagtttgatcctggctcaggacgaacgctggcggcgtgcttaacacatgcaagtcgaacgatgaagcccttcggggtggattagtggcgaacgggtgagtaacacgtgggcaatctgccctgcactctgggacaagccctggaaacggggtctaataccggatacgagcctcctgggcatctgggaggttggaaagctccggcggtgcaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcgcgtcgattgtgaaagcccggggcttaactccgggtctgcagtcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggcactaggtgttggcgacattccacgtcgtcggtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaacatccagagatgggtgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccctcggggagggagctgtcgaaggtgggactggcgattgggacgaagtcgtaacaaggtagccgtaccggaaggtgcggctggatcacctcctttcta

SEQ ID NO: 9424 - DNA, 1448 bp, Streptomyces sp. NRRL S-1896
  ref <308>: DATABASE ACCESSION NUMBER: NCBI ACCESSION: NZ_JOIV01000128.1
  ref <309>: DATABASE ENTRY DATE: 2019-04-01
  ref <313>: RELEVANT RESIDUES IN SEQ ID NO: (1)..(1448)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggatacgagtttcacgggcatccgtgattctggaaagctccggcggtgaaggatgagcccgcggcctatcagcttgttggtgaggtaatggctcaccaaggcgacgacgggtagccggcctgagagggcgacgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggcactaggtgttggcgacattccacgtcgtcggtgccgcagctaacgcattaagtgccccgcctggggagtacggccgcaaggctaaaactcaaaggaattgacgggggcccgcacaagcagcggagcatgtggcttaattcgacgcaacgcgaagaaccttaccaaggcttgacatacaccggaaacgtctggagacaggcgcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaaagagctgcgataccgtgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagttggtaacacccgaagccggtggcccaaccccttgtgggagggagctgtcgaaggtgggactagcgattgggacgaagtcgtaacaaggtagccgtaccggaaggtgcggctggatcacctcctttcta

SEQ ID NO: 9425 - DNA, 1530 bp, Streptomyces sp. NRRL S-31
  ref <308>: DATABASE ACCESSION NUMBER: NCBI ACCESSION: NZ_JOCB01000196.1
  ref <309>: DATABASE ENTRY DATE: 2019-04-01
  ref <313>: RELEVANT RESIDUES IN SEQ ID NO: (1)..(1530)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggatatgagcctgggaggcatctcccgggttgtaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcacgtcgattgtgaaagcccgaggcttaacctcgggtctgcagtcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaagcattagagatagtgccccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaaagagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9426 - DNA, 1531 bp, Streptomyces sp. NRRL WC-3723; identical to SEQ ID NO: 9324
  ref <308>: DATABASE ACCESSION NUMBER: NCBI ACCESSION: NZ_LGDX01000113.1
  ref <309>: DATABASE ENTRY DATE: 2019-04-01
  ref <313>: RELEVANT RESIDUES IN SEQ ID NO: (1)..(1531)

SEQ ID NO: 9427 - DNA, 1414 bp, Streptomyces sp. NRRL WC-3725
  ref <308>: DATABASE ACCESSION NUMBER: NCBI ACCESSION: NZ_JOJH01000107.1
  ref <309>: DATABASE ENTRY DATE: 2019-04-01
  ref <313>: RELEVANT RESIDUES IN SEQ ID NO: (1)..(1414)
cattcacggagagtttgatcctggctcaggacgaacgctggcggcgtgcttaacacatgcaagtcgaacgatgaaccacttcggtggggattagtgggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggcactaggtgttggcgacattccacgtcgtcggtgccgcagctaacgcattaagtgccccgcctggggagtacggccgcaaggctaaaactcaaaggaattgacgggggcccgcacaagcagcggagcatgtggcttaattcgacgcaacgcgaagaaccttaccaaggcttgacatacaccggaaacgtctggagacaggcgcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaaagagctgcgataccgtgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagttggtaacacccgaagccggtggcccaaccccttgtgggagggagctgtcgaaggtgggactagcgattgggacgaagtcgtaacaaggtagccgtaccggaaggtgcggctggatcacctcctttcta

SEQ ID NO: 9428 - DNA, 1458 bp, Streptomyces sp. NRRL WC-3744
  ref <308>: DATABASE ACCESSION NUMBER: NCBI ACCESSION: NZ_JOCJ01000001.1
  ref <309>: DATABASE ENTRY DATE: 2019-04-01
  ref <313>: RELEVANT RESIDUES IN SEQ ID NO: (1)..(1458)
aaccacttcggtggggattagtggcgaacgggtgagtaacacgtgggcaatctgcccttcactctgggacaagccctggaaacggggtctaataccggatacgagtttcacgggcatccgtgattctggaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggcactaggtgttggcgacattccacgtcgtcggtgccgcagctaacgcattaagtgccccgcctggggagtacggccgcaaggctaaaactcaaaggaattgacgggggcccgcacaagcagcggagcatgtggcttaattcgacgcaacgcgaagaaccttaccaaggcttgacatacaccggaaacgtctggagacaggcgcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaaagagctgcgataccgtgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagttggtaacacccgaagccggtggcccaaccccttgtgggagggagctgtcgaaggtgggactagcgattgggacgaagtcgtaacaaggtagccgtaccggaaggtgcggctggatcacctcctttcta

SEQ ID NO: 9429 - DNA, 1531 bp, Streptomyces sp. PanSC19
  ref <308>: DATABASE ACCESSION NUMBER: NCBI ACCESSION: NZ_RJUN01000001.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggatacgacctgccgaggcatctcggcgggtggaaagctccggcggtgaaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcatccgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaacacccagagatgggtgcccccttgtggtcggtatacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaaagagctgcgatgccgtgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9430 - DNA, 1531 bp, Streptomyces sp. PanSC9
  ref <308>: DATABASE ACCESSION NUMBER: NCBI ACCESSION: NZ_RJKP01000001.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggatatcactcctgcaggcatctgcgggggtcgaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaacgtctggagacaggcgcccccttgtggtcggtgtacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagttggtaacacccgaagccggtggcccaaccccttgtgggagggagctgtcgaaggtgggactagcgattgggacgaagtcgtaacaaggtagccgtaccggaaggtgcggctggatcacctcctttcta

SEQ ID NO: 9431 - DNA, 1536 bp, Streptomyces sp. RFCAC02
  ref <308>: DATABASE ACCESSION NUMBER: NCBI ACCESSION: NZ_SAUH01000001.1
  ref <309>: DATABASE ENTRY DATE: 2019-04-01
  ref <313>: RELEVANT RESIDUES IN SEQ ID NO: (1)..(1536)
cattcacggagagtttgatcctggctcaggacgaacgctggcggcgtgcttaacacatgcaagtcgaacgatgaaccggtttcggccggggattagtggcgaacgggtgagtaacacgtgggtaatctgccctgcactctgggataagcctgggaaactgggtctaataccggataggactcgtggtcgcatggcctcgagtggaaagcttttgcggtgtgggatgggcccgcggcctatcagcttgttggtggggtagtggcctaccaaggcgacgacgggtagccggcctgagagggtgatcggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcaccggctaactacgtgccagcagccgcggtaatacgtagggtgcaagcgttgtccggaattattgggcgtaaagagctcgtaggcggcttgtcgcgtcggttgtgaaagcccggggcttaaccccgggtctgcagtcgatacgggcaggctagagttcggcaggggagactggaattcctggtgtagcggtggaatgcgcagatatcaggaggaacaccggtggcgaaggcgggtctctgggccgatactgacgctgaggagcgaaagcgtggggagcgaacaggattagataccctggtagtccacgctgtaaacggtgggcactaggtgtgggcggcattccacgtcgtccgtgccgtagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacgccggaaacgtccagagatgggcgccctctttgagtcggtgtacaggtggtgcatggctgtcgtcagctcgtgtcgtgagatgttgggttaagtcccgcaacgagcgcaacccttgtcctgtgttgccagcaacatccctttggggtggttggggactcacgggagactgccggggtcaactcggaggaaggtggggacgacgtcaagtcatcatgccccttatgtcttgggctgcacacgtgctacaatggccggtacaatgagctgcgatgccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcctaaccccttgtgggagggagctgtcgaaggtgggactggcgattgggacgaagtcgtaacaaggtagccgtaccggaaggtgcggctggatcacctcctttcta

SEQ ID NO: 9432 - DNA, 1531 bp, Streptomyces sp. RP5T
  ref <308>: DATABASE ACCESSION NUMBER: NCBI ACCESSION: NZ_RSAJ01000998.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggatagcactaccacgggcatctgtggtggttgaaagctccggcggtgaaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaacgtccagagatgggcgcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagaccgccggggtcaactcggaggaaggtggggacgacgtcaagtcatcatgccccttatgtcttgggctgcacacgtgctacaatggcaggtacaatgagctgcgataccgtgaggtggagcgaatctcaaaaagcctgtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9433 - DNA, 1533 bp, Streptomyces sp. S063
  ref <308>: DATABASE ACCESSION NUMBER: NCBI ACCESSION: NZ_CP021707.1
  ref <309>: DATABASE ENTRY DATE: 2019-04-01
  ref <313>: RELEVANT RESIDUES IN SEQ ID NO: (1)..(1533)
cattcacggagagtttgatcctggctcaggacgaacgctggcggcgtgcttaacacatgcaagtcgaacgatgaagccgcttcggtggcggattagtggcgaacgggtgagtaacacgtgggcaatctgcccttcactctgggacaagccctggaaacggggtctaataccggataacactctgtcccgcatgggacggggttgaaagctccggcggtgaaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcatcagagatggtgccccccttgtggtcggtatacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgatgccgcgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9434 - DNA, 916 bp, Streptomyces sp. S1
  ref <308>: DATABASE ACCESSION NUMBER: NCBI ACCESSION: NZ_QVMS01000409.1
  ref <309>: DATABASE ENTRY DATE: 2019-04-01
  ref <313>: RELEVANT RESIDUES IN SEQ ID NO: (1)..(916)
cattcacggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggataacaccggcttccgcatgggagctggttgaaagctccggcggtgaaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcatccgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagc

SEQ ID NO: 9435 - DNA, 1531 bp, Streptomyces sp. S5; identical to SEQ ID NO: 9384
  ref <308>: DATABASE ACCESSION NUMBER: NCBI ACCESSION: NZ_QVMR01000988.1
  ref <309>: DATABASE ENTRY DATE: 2019-04-01
  ref <313>: RELEVANT RESIDUES IN SEQ ID NO: (1)..(1531)

SEQ ID NO: 9436 - DNA, 1530 bp, Streptomyces sp. SCA2-2
  ref <308>: DATABASE ACCESSION NUMBER: NCBI ACCESSION: NZ_PKMX01000015.1
  ref <309>: DATABASE ENTRY DATE: 2019-04-01
  ref <313>: RELEVANT RESIDUES IN SEQ ID NO: (1)..(1530)
cattcacggagagtttgatcctggctcaggacgaacgctggcggcgtgcttaacacatgcaagtcgaacgatgaagcccttcggggtggattagtggcgaacgggtgagtaacacgtgggcaatcttccctgcactctgggacaagccctggaaacggggtctaataccggatatgactttccaccgcatggtggatggtgtaaagctccggcggtgcaggatgagcccgcggcctatcagcttgttggtgaggtagtggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaacgtctggagacaggcgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9437 - DNA, 935 bp, Streptomyces sp. SS
  ref <308>: DATABASE ACCESSION NUMBER: NCBI ACCESSION: NZ_AKXV01000069.1
  ref <309>: DATABASE ENTRY DATE: 2019-04-01
  ref <313>: RELEVANT RESIDUES IN SEQ ID NO: (1)..(935)
ccccgggtctgcatccgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcattagagatagtgccccccttgtggtcggtatacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaaagagctgcgatgccgcgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9438 - DNA, 1530 bp, Streptomyces sp. SYSU K10008
  ref <308>: DATABASE ACCESSION NUMBER: NCBI ACCESSION: NZ_RPDJ01000104.1
  ref <309>: DATABASE ENTRY DATE: 2019-04-01
  ref <313>: RELEVANT RESIDUES IN SEQ ID NO: (1)..(1530)
cattcacggagagtttgatcctggctcaggacgaacgctggcggcgtgcttaacacatgcaagtcgaacgatgaagcccttcggggtggattagtggcgaacgggtgagtaacacgtgggcaatctgccctgcactctgggacaagccctggaaacggggtctaataccggatatcacttccactcgcatgggtgggggttgaaagctccggcggtgcaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaacatccagagatgggtgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgatgccgtgaggcggagcgaatctcaaaaagccggtctcagttcggattggggtctgcaactcgaccccatgaagtcggagtcgctagtaatcgcagatcagcagtgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9439 - DNA, 1531 bp, Streptomyces sp. San01
  ref <308>: DATABASE ACCESSION NUMBER: NCBI ACCESSION: NZ_RZYA01000047.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaagcccttcggggtggattagtggcgaacgggtgagtaacacgtgggcaatctgccctgcactctgggacaagccctggaaacggggtctaataccggataacacccctcatcgcatggtgaggggttgaaagctccggcggtgcaggatgagcccgcggcctatcagcttgttggtgaggtagaagctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcattagagatagtgccccccttgtggtcggtatacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggcaggtacaatgagctgcgatgccgcgaggcggagcgaatctcaaaaagcctgtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9440 - DNA, 1531 bp, Streptomyces sp. SirexAA-E
  ref <308>: DATABASE ACCESSION NUMBER: NCBI ACCESSION: NC_015953.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggataacactctgtcccgcatgggacggggttaaaagctccggcggtgaaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcatcagagatggtgccccccttgtggtcggtatacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgaagtcgtgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9441 - DNA, 1522 bp, Streptomyces sp. TLI 171
  ref <308>: DATABASE ACCESSION NUMBER: NCBI ACCESSION: NZ_RAPS01000001.1
  ref <309>: DATABASE ENTRY DATE: 2019-04-01
  ref <313>: RELEVANT RESIDUES IN SEQ ID NO: (1)..(1522)
cattcacggagagtttgatcctggctcaggacgaacgctggcggcgtgcttaacacatgcaagtcgaacggtgaagcccttcggggtggatcagtggcgaacgggtgagtaacacgtggggaatctgccctgaactctgggacaagccttggaaacgaggtctaataccggatacgaccttctcctgcatgggggttggtggaaagctccggcggttcaggatgatcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcaccggctaactacgtgccagcagccgcggtaatacgtagggtgcgagcgttgtccggaattattgggcgtaaagagctcgtaggcggcctgtcgcgtcggatgtgaaagcccggggcttaaccccgggtctgcattcgatacgggcaggctggagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacgccggaaacgtctagagataggcgcccccttgtggtcggtgtacaggtggtgcatggttgtcgtcagctcgtgtcgtgagatgttgggttaagtcccgcaacgagcgcaacccttgttctgtgttgccagcgagtaatgtcggggactcacaggagactgccggggtcaactcggaggaaggtggggacgacgtcaaatcatcatgccccttatgtcttgggctgcacacgtgctacaatggccggtacaaagggctgcgatgccgtgaggcggagcgaatcccaaaaagccggtctcagttcggattggggtctgcaactcgaccccatgaagttggagttgctagtaatcgcagatcagcatgctgcggtgaatacgttcccgggccttgtacacaccgcccgtcacgtcacgaaagtcggtaacacccgaagccggtggcctaacccgtaaggggaggagccgtcgaaggtgggaccagcgattgggacgaagtcgtaacaaggtagccgtaccggaaggtgcggctggatcacctcctttcta

SEQ ID NO: 9442 - DNA, 1531 bp, Streptomyces sp. TLI 185
  ref <308>: DATABASE ACCESSION NUMBER: NCBI ACCESSION: NZ_RKRB01000001.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggatatgagcctgggaggcatctcccgggttgtaaagctccggcggtgaaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaacatccagagatgggtgcccccttgtggtcggtgtacaggtggtgcatggctgtcgtcagctcgtgtcgtgagatgttgggttaagtcccgcaacgagcgcaacccttgtcccgtgttgccagcatgcccttcggggtgatggggactcacgggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagttgctagtaatcgcagatcagcagtgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9443 - DNA, 1534 bp, Streptomyces sp. TM32
  ref <308>: DATABASE ACCESSION NUMBER: NCBI ACCESSION: NZ_SDIG01000273.1
  ref <309>: DATABASE ENTRY DATE: 2019-04-01
  ref <313>: RELEVANT RESIDUES IN SEQ ID NO: (1)..(1534)
cattcacggagagtttgatcctggctcaggacgaacgctggcggcgtgcttaacacatgcaagtcgaacgatgaacctccttcgggaggggattagtggcgaacgggtgagtaacacgtgggcaatctgcccttcactctgggacaagccctggaaacggggtctaataccggatacgacacacgaccgcatggtatgtgtgtggaaagctccggcggtgaaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcgcgtcggatgtgaaagcccggggcttaaccccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgtcgtccgtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaaaccctggagacagggtcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggaatcgtcgaaggtgggactggcgattgggacgaagtcgtaacaaggtagccgtaccggaaggtgcggctggatcacctcctttcta

SEQ ID NO: 9444 - DNA, 1531 bp, Streptomyces sp. TRM44457
  ref <308>: DATABASE ACCESSION NUMBER: NCBI ACCESSION: NZ_SDOY01000026.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggatacgactgcgggaggcatctcctgtggtggaaagctccggcggtgaaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcatccgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaacatccagagatgggtgcccccttgtggtcggtatacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaaagagctgcgatgccgcgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9445 - DNA, 1533 bp, Streptomyces sp. Termitarium-T10T-6
  ref <308>: DATABASE ACCESSION NUMBER: NCBI ACCESSION: NZ_FMCO01000635.1
  ref <309>: DATABASE ENTRY DATE: 2019-04-01
  ref <313>: RELEVANT RESIDUES IN SEQ ID NO: (1)..(1533)
cattcacggagagtttgatcctggctcaggacgaacgctggcggcgtgcttaacacatgcaagtcgaacgatgaagccgcttcggtggtggattagtggcgaacgggtgagtaacacgtgggcaatctgcccttcactctgggacaagccctggaaacggggtctaataccggataacactctgtcccgcatgggacggggttgaaagctccggcggtgaaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcatcagagatggtgccccccttgtggtcggtatacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgatgccgcgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9446 - DNA, 1529 bp, Streptomyces sp. W1SF4
  ref <308>: DATABASE ACCESSION NUMBER: NCBI ACCESSION: NZ_CP034350.1
  ref <309>: DATABASE ENTRY DATE: 2019-04-01
  ref <313>: RELEVANT RESIDUES IN SEQ ID NO: (1)..(1529)
cattcatggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggatacgactgcgggaggcatctcctgtggtggaaagctccggcggtgaaggatgagcccgcggcctatcagcttgttggtggggtaatggcccaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccgaggcttaacctcgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatataccggaaagcattagagatagtgccccccttgtggtcggtatacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccttgtggagggagctgtcgaaggtgggactggcgattgggacgaagtcgtaacaaggtagccgtaccggaaggtgcggctggatcacctcctttcta

SEQ ID NO: 9447 - DNA, 1533 bp, Streptomyces sp. WAC00469
  ref <308>: DATABASE ACCESSION NUMBER: NCBI ACCESSION: NZ_RPRX01000155.1
  ref <309>: DATABASE ENTRY DATE: 2019-04-01
  ref <313>: RELEVANT RESIDUES IN SEQ ID NO: (1)..(1533)
cattcacggagagtttgatcctggctcaggacgaacgctggcggcgtgcttaacacatgcaagtcgaacgatgaagccccttcgggggtggattagtggcgaacgggtgagtaacacgtgggcaatctgccctgcactctgggacaagccctggaaacggggtctaataccggatacgacacagggaggcatctcctctgtgtggaaagctccggcggtgcaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcgcgtcggttgtgaaagcccggggcttaactccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcagcattccacgttgtccgtgccgtagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaacatccagagatgggtgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaaagagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9448 - DNA, 1553 bp, Streptomyces sp. WAC01280; identical to SEQ ID NO: 8789
  ref <308>: DATABASE ACCESSION NUMBER: NCBI ACCESSION: NZ_RPSA01000015.1
  ref <309>: DATABASE ENTRY DATE: 2019-04-01
  ref <313>: RELEVANT RESIDUES IN SEQ ID NO: (1)..(1553)

SEQ ID NO: 9449 - DNA, 1530 bp, Streptomyces sp. WAC02707
  ref <308>: DATABASE ACCESSION NUMBER: NCBI ACCESSION: NZ_RPSB01000114.1
  ref <309>: DATABASE ENTRY DATE: 2019-04-01
  ref <313>: RELEVANT RESIDUES IN SEQ ID NO: (1)..(1530)
cattcacggagagtttgatcctggctcaggacgaacgctggcggcgtgcttaacacatgcaagtcgaacgatgaaccacttcggtggggattagtggcgaacgggtgagtaacacgtgggcaatctgccctgcactctgggacaagccctggaaacggggtctaataccggatactgatcctcgcaggcatctgcgaggttcgaaagctccggcggtgcaggatgagcccgcggcctatcagctagttggtgaggtaacggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaaaccctggagacagggtcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttct

SEQ ID NO: 9450 - DNA, 1530 bp, Streptomyces sp. WAC04189
  ref <308>: DATABASE ACCESSION NUMBER: NCBI ACCESSION: NZ_RPRT01000037.1
  ref <309>: DATABASE ENTRY DATE: 2019-04-01
  ref <313>: RELEVANT RESIDUES IN SEQ ID NO: (1)..(1530)
cattcacggagagtttgatcctggctcaggacgaacgctggcggcgtgcttaacacatgcaagtcgaacgatgaaccacttcggtggggattagtggcgaacgggtgagtaacacgtgggcaatctgccctgcactctgggacaagccctggaaacggggtctaataccggatactgatcctcgcaggcatctgcgaggttcgaaagctccggcggtgcaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaaaccctggagacagggtcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttct

SEQ ID NO: 9451 - DNA, 1533 bp, Streptomyces sp. WAC04770
  ref <308>: DATABASE ACCESSION NUMBER: NCBI ACCESSION: NZ_RQIR01000498.1
  ref <309>: DATABASE ENTRY DATE: 2019-04-01
  ref <313>: RELEVANT RESIDUES IN SEQ ID NO: (1)..(1533)
cattcacggagagtttgatcctggctcaggacgaacgctggcggcgtgcttaacacatgcaagtcgaacgatgaaaccgcttcggtggtggattagtggcgaacgggtgagtaacacgtgggcaatctgcccttcactctgggacaagccctggaaacggggtctaataccggataatactcctgcctgcatgggtgggggttgaaagctccggcggtgaaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcatcagagatggtgccccccttgtggtcggtatacaggtggtgcatggctgtcgtcagctcgtgtcgtgagatgttgggttaagtcccgcaacgagcgcaacccttgttctgtgttgccagcatgcctttcggggtgatggggactcacaggagactgccggggtcaactcggaggaaggtggggacgacgtcaagtcatcatgccccttatgtcttgggctgcacacgtgctacaatggccggtacaatgagctgcgatgccgtgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9452 - DNA, 1531 bp, Streptomyces sp. WAC05292
  ref <308>: DATABASE ACCESSION NUMBER: NCBI ACCESSION: NZ_RPSE01000437.1
  ref <309>: DATABASE ENTRY DATE: 2019-04-01
  ref <313>: RELEVANT RESIDUES IN SEQ ID NO: (1)..(1531)
cattcatggagagtttgatcctggctcaggacgaacgctggcggcgtgcttaacacatgcaagtcgaacgatgaacctccttcgggaggggattagtggcgaacgggtgagtaacacgtgggcaatctgcccttcactctgggacaagccctggaaacggggtctaataccggatacgactgcggaaggcatcttccgcggtggaaagctccggcggtgaaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggccagtcacgtcggatgtgaaagcccgaggcttaacctcgggtctgcattcgatacgggctggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatataccggaaagcattagagatagtgccccccttgtggtcggtatacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccttgtggagggagccgtcgaaggtgggactggcgattgggacgaagtcgtaacaaggtagccgtaccggaaggtgcggctggatcacctcctttcta

SEQ ID NO: 9453 - DNA, 1533 bp, Streptomyces sp. WAC05374
  ref <308>: DATABASE ACCESSION NUMBER: NCBI ACCESSION: NZ_RQJD01000356.1
  ref <309>: DATABASE ENTRY DATE: 2019-04-01
  ref <313>: RELEVANT RESIDUES IN SEQ ID NO: (1)..(1533)
cattcacggagagtttgatcctggctcaggacgaacgctggcggcgtgcttaacacatgcaagtcgaacgatgaacccacttcggtgggggattagtggcgaacgggtgagtaacacgtgggcaatctgcccttcactctgggacaagccctggaaacggggtctaataccggatacgaccactgagggcatcctcggtggtggaaagctccggcggtgaaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaacggccagagatggtcgcccccttgtggtcggtatacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaaagagctgcgaagccgtgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9454 - DNA, 1530 bp, Streptomyces sp. WAC05458; identical to SEQ ID NO: 9450
  ref <308>: DATABASE ACCESSION NUMBER: NCBI ACCESSION: NZ_RPRU01000067.1
  ref <309>: DATABASE ENTRY DATE: 2019-04-01
  ref <313>: RELEVANT RESIDUES IN SEQ ID NO: (1)..(1530)

SEQ ID NO: 9455 - DNA, 1532 bp, Streptomyces sp. WAC05858
  ref <308>: DATABASE ACCESSION NUMBER: NCBI ACCESSION: NZ_RPRR01000524.1
  ref <309>: DATABASE ENTRY DATE: 2019-04-01
  ref <313>: RELEVANT RESIDUES IN SEQ ID NO: (1)..(1532)
cattcacggagagtttgatcctggctcaggacgaacgctggcggcgtgcttaacacatgcaagtcgaacgatgaaccggtttcggccggggattagtggcgaacgggtgagtaacacgtgggcaatctgccctgcactctgggacaagccctggaaacggggtctaataccggatatgacacgctcccgcatgggatgcgtgtggaaagctccggcggtgcaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcgcgtcggatgtgaaagcccggggcttaaccccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgtcgtccgcgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaacctctggagacaggggcccccttgtggtcggtgtacaggtggtgcatggctgtcgtcagctcgtgtcgtgagatgttgggttaagtcccgcaacgagcgcaacccttgttctgtgttgccagcatgcctttcggggtgatggggactcacaggagactgccggggtcaactcggaggaaggtggggacgacgtcaagtcatcatgccccttatgtcttgggctgcacacgtgctacaatggccggtacaatgagctgcgaagccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccttgtggagggagccgtcgaaggtgggactggcgattgggacgaagtcgtaacaaggtagccgtaccggaaggtgcggctggatcacctcctttcta

SEQ ID NO: 9456 - DNA, 1530 bp, Streptomyces sp. WAC06128; identical to SEQ ID NO: 9450
  ref <308>: DATABASE ACCESSION NUMBER: NCBI ACCESSION: NZ_RPSC01000022.1
  ref <309>: DATABASE ENTRY DATE: 2019-04-01
  ref <313>: RELEVANT RESIDUES IN SEQ ID NO: (1)..(1530)

SEQ ID NO: 9457 - DNA, 1530 bp, Streptomyces sp. WAC06273; identical to SEQ ID NO: 9449
  ref <308>: DATABASE ACCESSION NUMBER: NCBI ACCESSION: NZ_RPSD01000019.1
  ref <309>: DATABASE ENTRY DATE: 2019-04-01
  ref <313>: RELEVANT RESIDUES IN SEQ ID NO: (1)..(1530)

SEQ ID NO: 9458 - DNA, 1529 bp, Streptomyces sp. WAC06614
  ref <308>: DATABASE ACCESSION NUMBER: NCBI ACCESSION: NZ_RPRY01000412.1
  ref <309>: DATABASE ENTRY DATE: 2019-04-01
  ref <313>: RELEVANT RESIDUES IN SEQ ID NO: (1)..(1529)
cattcacggagagtttgatcctggctcaggacgaacgctggcggcgtgcttaacacatgcaagtcgaacgatgaagcccttcggggtggattagtggcgaacgggtgagtaacacgtgggaaatctgccctgcactctgggacaagccttggaaacgaggtctaataccggatatgactgctgaccgcatggtcggtggtggaaagctccggcggtgcaggatgatcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgaaggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcgcgtcggatgtgaaagcccggggcttaaccccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgtcgtccgtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatataccggaaagcattagagatagtgccccccttgtggtcggtatacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccttgtggagggagctgtcgaaggtgggactggcgattgggacgaagtcgtaacaaggtagccgtaccggaaggtgcggctggatcacctcctttcta

SEQ ID NO: 9459 - DNA, 1529 bp, Streptomyces sp. WAC07061; identical to SEQ ID NO: 9446
  ref <308>: DATABASE ACCESSION NUMBER: NCBI ACCESSION: NZ_RPRS01000490.1
  ref <309>: DATABASE ENTRY DATE: 2019-04-01
  ref <313>: RELEVANT RESIDUES IN SEQ ID NO: (1)..(1529)

SEQ ID NO: 9460 - DNA, 1530 bp, Streptomyces sp. WAC07149
  ref <308>: DATABASE ACCESSION NUMBER: NCBI ACCESSION: NZ_RQJC01000087.1
  ref <309>: DATABASE ENTRY DATE: 2019-04-01
  ref <313>: RELEVANT RESIDUES IN SEQ ID NO: (1)..(1530)
cattcatggagagtttgatcctggctcaggacgaacgctggcggcgtgcttaacacatgcaagtcgaacgatgaagcccttcggggtggattagtggcgaacgggtgagtaacacgtgggcaatctgcccttcactctgggacaagccctggaaacggggtctaataccggataccactcctgcctgcatgggcgggagttgaaagctccggcggtgaaggatgagcccgcggcctatcagcttgttggtggggtaatggcccaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccgaggcttaacctcgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatataccggaaagcattagagatagtgccccccttgtggtcggtatacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccgtaagggagggagctgtcgaaggtgggaccagcgattgggacgaagtcgtaacaaggtagccgtaccggaaggtgcggctggatcacctcctttcta

SEQ ID NO: 9461 - DNA, 1531 bp, Streptomyces sp. WAC08241
  ref <308>: DATABASE ACCESSION NUMBER: NCBI ACCESSION: NZ_RPRZ01000406.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaagcctttcggggtggattagtggcgaacgggtgagtaacacgtgggcaatctgcccttcactctgggacaagccctggaaacggggtctaataccggatacgactgccggaggcatctcctggggtggaaagctccggcggtgaaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcatccgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcatcagagatggtgccccccttgtggtcggtatacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaaagagctgcgatgccgcgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9462 - DNA, 1530 bp, Streptomyces sp. WAC08401; identical to SEQ ID NO: 9449
  ref <308>: DATABASE ACCESSION NUMBER: NCBI ACCESSION: NZ_RPRV01000002.1
  ref <309>: DATABASE ENTRY DATE: 2019-04-01
  ref <313>: RELEVANT RESIDUES IN SEQ ID NO: (1)..(1530)

SEQ ID NO: 9463 - DNA, 1530 bp, Streptomyces sp. WAC08452; identical to SEQ ID NO: 9449
  ref <308>: DATABASE ACCESSION NUMBER: NCBI ACCESSION: NZ_RPRW01000040.1
  ref <309>: DATABASE ENTRY DATE: 2019-04-01
  ref <313>: RELEVANT RESIDUES IN SEQ ID NO: (1)..(1530)

SEQ ID NO: 9464 - DNA, 1531 bp, Streptomyces sp. WAC 00631
  ref <308>: DATABASE ACCESSION NUMBER: NCBI ACCESSION: NZ_QHKJ01000340.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaacctcttcggaggggattagtggcgaacgggtgagtaacacgtgggcaatctgccctgcactctgggacaagccctggaaacggggtctaataccggatacgaccatctcgggcatccgatggtggtggaaagctccggcggtgcaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggaagaagcgcaagtgacggtacctgcagaagaagcaccggctaactacgtgccagcagccgcggtaatacgtagggtgcgagcgttgtccggaattattgggcgtaaagagctcgtaggcggcttgtcacgtcggatgtgaaagcccggggcttaaccccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgtcgtccgtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaagccgtagagatacggccccccttgtggtcggtgtacaggtggtgcatggctgtcgtcagctcgtgtcgtgagatgttgggttaagtcccgcaacgagcgcaacccttgttctgtgttgccagcatgcctttcggggtgatggggactcacaggagactgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccgtaagggagggaatcgtcgaaggtgggactggcgattgggacgaagtcgtaacaaggtagccgtaccggaaggtgcggctggatcacctcctttcta

SEQ ID NO: 9465 - DNA, 1531 bp, Streptomyces sp. WAC 01325
  ref <308>: DATABASE ACCESSION NUMBER: NCBI ACCESSION: NZ_QHKK01000359.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggataacactcctgtcctcctggacgggggttaaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaacgtctggagacaggcgcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagaccgccggggtcaactcggaggaaggtggggacgacgtcaagtcatcatgccccttatgtcttgggctgcacacgtgctacaatggcaggtacaatgagctgcgataccgtgaggtggagcgaatctcaaaaagcctgtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9466 - DNA, 1358 bp, Streptomyces sp. WAC 01420
  ref <308>: DATABASE ACCESSION NUMBER: NCBI ACCESSION: NZ_QHHY01000141.1
  ref <309>: DATABASE ENTRY DATE: 2019-04-01
  ref <313>: RELEVANT RESIDUES IN SEQ ID NO: (1)..(1358)
tactgaaccgtctgggcatccaggcggttcgaaagctccggcggtgcaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcgagcgttgtccggaattattgggcgtaaagagctcgtaggcggcttgtcgcgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcgacattccacgtcgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaacatccagagatgggtgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgcaaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttct

SEQ ID NO: 9467 - DNA, 1532 bp, Streptomyces sp. WAC 01438
  ref <308>: DATABASE ACCESSION NUMBER: NCBI ACCESSION: NZ_CP029601.1
  ref <309>: DATABASE ENTRY DATE: 2019-04-01
  ref <313>: RELEVANT RESIDUES IN SEQ ID NO: (1)..(1532)
cattcacggagagtttgatcctggctcaggacgaacgctggcggcgtgcttaacacatgcaagtcgaacgatgaaccaccttcgggtggggattagtggcgaacgggtgagtaacacgtgggcaatctgccctgcactctgggacaagccctggaaacggggtctaataccggatactgaaccgtctgggcatccaggcggttcgaaagctccggcggtgcaggatgagcccgcggcctatcagcttgttggtgaggtaacggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcgagcgttgtccggaattattgggcgtaaagagctcgtaggcggcttgtcgcgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcgacattccacgtcgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaacatccagagatgggtgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgcaaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttct

SEQ ID NO: 9468 - DNA, 1531 bp, Streptomyces sp. WAC 01529
  ref <308>: DATABASE ACCESSION NUMBER: NCBI ACCESSION: NZ_CP029617.1
  ref <309>: DATABASE ENTRY DATE: 2019-04-01
  ref <313>: RELEVANT RESIDUES IN SEQ ID NO: (1)..(1531)
catttacggagagtttgatcctggctcaggacgaacgctggcggcgtgcttaacacatgcaagtcgaacgatgaaccacttcggtggggattagtggcgaacgggtgagtaacacgtgggcaatctgccctgcactctgggacaagccctggaaacggggtctaataccggataacacacgctcaggcatctgagtgtgttgaaagctccggcggtgcaggatgagcccgcggcctatcagcttgttggtgaggtagaagctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcatcagagatggtgccccccttgtggtcggtatacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggcaggtacaatgagctgcgaagccgcgaggcggagcgaatctcaaaaagcctgtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9469 - DNA, 1531 bp, Streptomyces sp. WAC 04229
  ref <308>: DATABASE ACCESSION NUMBER: NCBI ACCESSION: NZ_QHJH01000307.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaaccacttcggtggggattagtggcgaacgggtgagtaacacgtgggcaatctgccctgcactctgggacaagccctggaaacggggtctaataccggatactgaaccttacaggcatctgtgagggtcgaaagctccggcggtgcaggatgagcccgcggcctatcagctagttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcgcgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaacggccagagatggtcgcccccttgtggtcggtgtacaggtggtgcatggctgtcgtcagctcgtgtcgtgagatgttgggttaagtcccgcaacgagcgcaacccttgtcccgtgttgccagcaggcccttgtggtgctggggactcacgggagaccgccggggtcaactcggaggaaggtggggacgacgtcaagtcatcatgccccttatgtcttgggctgcacacgtgctacaatggccggtacaatgagctgcgataccgcaaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9470 - DNA, 1531 bp, Streptomyces sp. WAC 05379
  ref <308>: DATABASE ACCESSION NUMBER: NCBI ACCESSION: NZ_QHJL01000470.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggataatactcctgtcctcctggacgggggttaaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaagcattagagatagtgccccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagaccgccggggtcaactcggaggaaggtggggacgacgtcaagtcatcatgccccttatgtcttgggctgcacacgtgctacaatggcaggtacaatgagctgcgataccgtgaggtggagcgaatctcaaaaagcctgtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9471 - DNA, 1344 bp, Streptomyces sp. WAC 05977
  ref <308>: DATABASE ACCESSION NUMBER: NCBI ACCESSION: NZ_QHJM01000061.1
  ref <309>: DATABASE ENTRY DATE: 2019-04-01
  ref <313>: RELEVANT RESIDUES IN SEQ ID NO: (1)..(1344)
gggcctcgcatggggtttggtggaaagctccggcggtacaggatgagcccgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcgccagggacgaagcgcaagtgacggtacctggataagaagcaccggctaactacgtgccagcagccgcggtaatacgtagggtgcgagcgttgtccggaattattgggcgtaaagagctcgtaggcggtttgtcgcgtcgttcgtgaaaactccacgcttaacgtggagcgtgcgggcgatacgggcagacttgagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtgggcgacatccacgttgtccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgcgccagacatccctagagatagggcttcccttgtggttggtgtacaggtggtgcatggctgtcgtcagctcgtgtcgtgagatgttgggttaagtcccgcaacgagcgcaacccttatcctacgttgccagcgcgtcatggcggggactcgtgggagactgccggggtcaactcggaggaaggtggggatgacgtcaagtcatcatgccccttatgtccagggcttcacacatgctacaatggctggtacagagggctgcgataccgcgaggtggagcgaatcccttaaagccggtctcagttcggatcgcagtctgcaactcgactgcgtgaagtcggagtcgctagtaatcgcagatcagcaacgctgcggtgaatacgttcccgggccttgtacacaccgcccgtcacgtcatgaaagtcggtaacacccgaagcccatggcccaactcttcggagagggagtggtcgaaggtgggactggcgattgggacgaagtcgtaacaaggtagccgtaccggaaggtgcggctggatcacctcctttctaa

SEQ ID NO: 9472 - DNA, 1532 bp, Streptomyces sp. WAC 06725
  ref <308>: DATABASE ACCESSION NUMBER: NCBI ACCESSION: NZ_QHJO01000475.1
  ref <309>: DATABASE ENTRY DATE: 2019-04-01
  ref <313>: RELEVANT RESIDUES IN SEQ ID NO: (1)..(1532)
cattcacggagagtttgatcctggctcaggacgaacgctggcggcgtgcttaacacatgcaagtcgaacgatgaagcccttcggggtggattagtggcgaacgggtgagtaacacgtgggcaatctgccctgcactctgggacaagccctggaaacggggtctaataccggatatgacacacgaccgcatggtctgtgtgtggaaagctccggcggtgcaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggcttgtcgcgtcggatgtgaaagcccggggcttaaccccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgtcgtccgtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaacctctggagacaggggcccccttgtggtcggtgtacaggtggtgcatggctgtcgtcagctcgtgtcgtgagatgttgggttaagtcccgcaacgagcgcaacccttgttctgtgttgccagcatgcctttcggggtgatggggactcacaggagactgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggaatcgtcgaaggtgggactggcgattgggacgaagtcgtaacaaggtagccgtaccggaaggtgcggctggatcacctcctttcta

SEQ ID NO: 9473 - DNA, 1535 bp, Streptomyces sp. WAC 06738
  ref <308>: DATABASE ACCESSION NUMBER: NCBI ACCESSION: NZ_CP029618.1
  ref <309>: DATABASE ENTRY DATE: 2019-04-01
  ref <313>: RELEVANT RESIDUES IN SEQ ID NO: (1)..(1535)
catttacggagagtttgatcctggctcaggacgaacgctggcggcgtgcttaacacatgcaagtcgaacgatgatccggtttcggccggggattagtggcgaacgggtgagtaacacgtgggcaatctgccctgcactctgggacaagccctggaaacggggtctaataccggatagtaccttcgggcgcatgcctgttggtggaaagctccggcggtgcaggatgggcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggcttgtcgcgtcggatgtgaaagcccggggcttaaccccgggtctgcattcgatacgggcaggctggagttcggtaggggagatcggaattcctggtgtagcggtggaatgcgcagatatcaggaggaacaccggtggcgaaggcggatctctgggccgatactgacgctgaggagcgaaagcgtggggagcaaacaggattagataccctggtagtccacgccgtaaacggtgggcactaggtgtgggcggcattccacgtcgtccgtgccgtagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaacatccagagatgggtgcccccttgtggtcggtgtacaggtggtgcatggctgtcgtcagctcgtgtcgtgagatgttgggttaagtcccgcaacgagcgcaacccttgtcctgtgttgccagcacgctccttcgggggtggtggggactcacgggagactgccggggtcaactcggaggaaggtggggacgacgtcaagtcatcatgccccttatgtcttgggctgcacacgtgctacaatggccggtacaatgagctgcgataccgcaaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaaccccttgtgggagggagccgtcgaaggtgggactggcgattgggacgaagtcgtaacaaggtagccgtaccggaaggtgcggctggatcacctcctttcta

SEQ ID NO: 9474 - DNA, 1532 bp, Streptomyces sp. WAC 06783; identical to SEQ ID NO: 9472
  ref <308>: DATABASE ACCESSION NUMBER: NCBI ACCESSION: NZ_QHJP01000053.1
  ref <309>: DATABASE ENTRY DATE: 2019-04-01
  ref <313>: RELEVANT RESIDUES IN SEQ ID NO: (1)..(1532)

SEQ ID NO: 9475 - DNA, 1531 bp, Streptomyces sp. W SAI-097
  ref <308>: DATABASE ACCESSION NUMBER: NCBI ACCESSION: NZ_RKQH01000001.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggatatcactaccgcaggcatctgtggtggttgaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaagcattagagatagtgccccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagaccgccggggtcaactcggaggaaggtggggacgacgtcaagtcatcatgccccttatgtcttgggctgcacacgtgctacaatggcaggtacaatgagctgcgataccgtgaggtggagcgaatctcaaaaagcctgtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttcta

SEQ ID NO: 9476 - DNA, 1530 bp, Streptomyces sp. XY332; identical to SEQ ID NO: 9360
  ref <308>: DATABASE ACCESSION NUMBER: NCBI ACCESSION: NZ_LGHN01000022.1
  ref <309>: DATABASE ENTRY DATE: 2019-04-01
  ref <313>: RELEVANT RESIDUES IN SEQ ID NO: (1)..(1530)

SEQ ID NO: 9477 - DNA, 1536 bp, Streptomyces sp. YIM 130001
  ref <308>: DATABASE ACCESSION NUMBER: NCBI ACCESSION: NZ_KZ984589.1
  ref <309>: DATABASE ENTRY DATE: 2019-04-01
  ref <313>: RELEVANT RESIDUES IN SEQ ID NO: (1)..(1536)
cattcacggagagtttgatcctggctcaggacgaacgctggcggcgtgcttaacacatgcaagtcgaacgatgaacccgcttcggtgggggattagtggcgaacgggtgagtaacacgtgggcaatctgccctccactctgggacaagccctggaaacggggtctaataccggatacgacacagtcaggcatctgatctgtgtggaaagctccggcggtggaggatgagcccgcggcctatcagctagttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacggtgggcactaggtgtgggcaacattccacgttgtccgtgccgcagctaacgcattaagtgccccgcctggggagtacggccgcaaggctaaaactcaaaggaattgacgggggcccgcacaagcagcggagcatgtggcttaattcgacgcaacgcgaagaaccttaccaaggcttgacatacaccggaaacggccagagatggtcgcccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaatgagctgcgataccgcaaggtggagcgaatctcaaaaagccggtctcagttcggattggggtctgcaactcgaccccatgaagttggagttgctagtaatcgcagatcagcattgctgcggtgaatacgttcccgggccttgtacacaccgcccgtcacgtcacgaaagtcggtaacacccgaagccggtggcccaacccccttgtggggagggagctgtcgaaggtgggaccagcgattgggacgaagtcgtaacaaggtagccgtaccggaaggtgcggctggatcacctcctttcta

SEQ ID NO: 9478 - DNA, 1531 bp, Streptomyces sp. Z022
  ref <308>: DATABASE ACCESSION NUMBER: NCBI ACCESSION: NZ_CP033073.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaaccacttcggtggggattagtggcgaacgggtgagtaacacgtgggcaatctgcccttcactctgggacaagccctggaaacggggtctaataccggatatgaccatcttgggcatccttgatggtgtaaagctccggcggtgaaggatgagcccgcggcctatcagcttgttggtgaggtaatggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaagcattagagatagtgccccccttgtggtcggtgtacaggtggtgcatggctgtcgtcagctcgtgtcgtgagatgttgggttaagtcccgcaacgagcgcaacccttgtcctgtgttgccagcatgcccttcggggtgatggggactcacaggagaccgccggggtcaactcggaggaaggtggggacgacgtcaagtcatcatgccccttatgtcttgggctgcacacgtgctacaatggccggtacaatgagctgcgataccgtgaggtggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagttggtaacacccgaagccggtggcccaaccccttgtgggagggagctgtcgaaggtgggactagcgattgggacgaagtcgtaacaaggtagccgtaccggaaggtgcggctggatcacctcctttcta

SEQ ID NO: 9479 - DNA, 1532 bp, Streptomyces sp. Z26
  ref <308>: DATABASE ACCESSION NUMBER: NCBI ACCESSION: NZ_RCHV01000002.1
  ref <309>: DATABASE ENTRY DATE: 2019-04-01
  ref <313>: RELEVANT RESIDUES IN SEQ ID NO: (1)..(1532)
cattcatggagagtttgatcctggctcaggacgaacgctggcggcgtgcttaacacatgcaagtcgaacgatgatccggtttcggccggggattagtggcgaacgggtgagtaacacgtgggcaatctgccctgcactctgggacaagccctggaaacggggtctaataccggatacgaccactgaccgcatggttggtggtggaaagcgtttagtggtgcaggatgagcccgcagcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggaagaagcgagagtgacggtacctgcagaagaagcaccggctaactacgtgccagcagccgcggtaatacgtagggtgcgagcgttgtccggaattattgggcgtaaagagctcgtaggcggcgtgtcacgtcggatgtgaaagcccggggcttaaccctgggtctgcattcgatacgggctcgctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgtcgtccgtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacgccggaaatctctggagacaggggctccctttgggccggtgtacaggtggtgcatggctgtcgtcagctcgtgtcgtgagatgttgggttaagtcccgcaacgagcgcaacccttgtcctgtgttgccagcacgcccttcggggtggtggggactcacgggagactgccggggtcaactcggaggaaggtggggacgacgtcaagtcatcatgccccttatgtcttgggctgcacacgtgctacaatggccggtacaatgagctgcgaagtcgtaaggcggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccttgtggggggagccgtcgaaggtgggactggcgattgggacgaagtcgtaacaaggtagccgtaccggaaggtgcggctggatcacctcctttcta

SEQ ID NO: 9480 - DNA, 1530 bp, Streptomyces sp. endophyte N2; identical to SEQ ID NO: 9332
  ref <308>: DATABASE ACCESSION NUMBER: NCBI ACCESSION: NZ_CP028719.1
  ref <309>: DATABASE ENTRY DATE: 2019-04-01
  ref <313>: RELEVANT RESIDUES IN SEQ ID NO: (1)..(1530)

SEQ ID NO: 9481 - DNA, 1523 bp, Streptomyces spongiicola
  ref <308>: DATABASE ACCESSION NUMBER: NCBI ACCESSION: NZ_BGZL01000061.1
  ref <309>: DATABASE ENTRY DATE: 2019-04-01
  ref <313>: RELEVANT RESIDUES IN SEQ ID NO: (1)..(1523)
cattcacggagagtttgatcctggctcaggacgaacgctggcggcgtgcttaacacatgcaagtcgaacgatgaacctctttcgggaggggattagtggcgaacgggtgagtaacacgtgggcaatctgccctgcactctgggacaagccctggaaacggggtctaataccggatatgaccatcgggggcatccctggtggtggaaagctccggcggtgcaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggaagaagcgtgagtgacggtacctgcagaagaagcgccggctaactacgtgccagcagccgcggtaatacgtagggcgcgagcgttgtccggaattattgggcgtaaagagctcgtaggcggcttgtcgcgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggcactaggtgtgggcgacattccacgtcgtccgtgccgcagctaacgcattaagtgccccgcctggggagtacggccgcaaggctaaaactcaaaggaattgacgggggcccgcacaagcggcggagcatgtggcttaattcgacgcaacgcgaagaaccttaccaaggcttgacatacaccggaaagcatcagagatggtgccccccttgtggtcggtgtacaggtggtgcatggctgtcgtcagctcgtgtcgtgagatgttgggttaagtcccgcaacgagcgcaacccctgtcctgtgttgccagcgggtcatgccggggactcacaggagaccgccggggtcaactcggaggaaggtggggacgacgtcaagtcatcatgccccttatgtcttgggctgcacacgtgctacaatggccggtacaatgagctgcgatgccgtgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccttgggagggagccgtcgaaggtgggactggcgattgggacgaagtcgtaacaaggtagccgtaccggaaggtgcggctggatcacctcctttcta

SEQ ID NO: 9482 - DNA, 1529 bp, Streptomyces xanthocidicus
  ref <308>: DATABASE ACCESSION NUMBER: NCBI ACCESSION: NZ_QVIG01000001.1
  ref <309>: DATABASE ENTRY DATE: 2019-04-01
  ref <313>: RELEVANT RESIDUES IN SEQ ID NO: (1)..(1529)
cattcacggagagtttgatcctggctcaggacgaacgctggcggcgtgcttaacacatgcaagtcgaacggtgaagcccttcggggtggatcagtggcgaacgggtgagtaacacgtgggcaatctgccctgcactctgggacaagccctggaaacggggtctaataccggatacgaccttcctccgcatgggggttggtggaaagctccggcggtgcaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggacgacggccttcgggttgtaaacctctttcagcagggaagaagcgcaagtgacggtacctgcagaagaagcaccggctaactacgtgccagcagccgcggtaatacgtagggtgcgagcgttgtccggaattattgggcgtaaagagctcgtaggcggcctgtcgcgtcggatgtgaaagcccggggcttaaccccgggtctgcattcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatatgccggaaacacctggagacaggtgcccccttgtggtcggtatacaggtggtgcatggttgtcgtcagctcgtgtcgtgagatgttgggttaagtcccgcaacgagcgcaacccttgttctgtgttgccagcatgcctttcggggtgatggggactcacaggagactgccggggtcaactcggaggaaggtggggacgacgtcaaatcatcatgccccttatgtcttgggctgcacacgtgctacaatggtcggtacaaagggctgcgatgccgcgaggcggagcgaatcccaaaaagccggcctcagttcggattggggtctgcaactcgaccccatgaagttggagttgctagtaatcgcagatcagcatgctgcggtgaatacgttcccgggccttgtacacaccgcccgtcacgtcacgaaagtcggtaacacccgaagccggtggcctaacccgtaaggggaggagccgtcgaaggtgggaccagcgattgggacgaagtcgtaacaaggtagccgtaccggaaggtgcggctggatcacctcctttcta

SEQ ID NO: 9483 - DNA, 1531 bp, Streptomyces xinghaiensis
  ref <308>: DATABASE ACCESSION NUMBER: NCBI ACCESSION: NZ_QFBD02000037.1
  ref <309>: DATABASE ENTRY DATE: 2019-04-01
  ref <313>: RELEVANT RESIDUES IN SEQ ID NO: (1)..(1531)
cattcacggagagtttgatcctggctcaggacgaacgctggcggcgtgcttaacacatgcaagtcgaacgatgaacctcttcggaggggattagtggcgaacgggtgagtaacacgtgggcaatctgccctgcactctgggacaagccctggaaacggggtctaataccggatacgaccatctcgggcatccgatggtggtggaaagctccggcggtgcaggatgagcccgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggaagaagcgcaagtgacggtacctgcagaagaagcaccggctaactacgtgccagcagccgcggtaatacgtagggtgcgagcgttgtccggaattattgggcgtaaagagctcgtaggcggcttgtcgcgtcggatgtgaaagcccggggcttaaccccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacaggattagataccctggtagtccacgccgtaaacgttgggaactaggtgtgggcgacattccacgtcgtccgtgccgcagctaacgcattaagttccccgcctggggagtacggccgcaaggctaaaactcaaaggaattgacgggggcccgcacaagcggcggagcatgtggcttaattcgacgcaacgcgaagaaccttaccaaggcttgacatacaccggaaagccgtagagatacggccccccttgtggtcggtgtacaggtggtgcatggctgtcgtcagctcgtgtcgtgagatgttgggttaagtcccgcaacgagcgcaacccttgttctgtgttgccagcatgcctttcggggtgatggggactcacaggagactgccggggtcaactcggaggaaggtggggacgacgtcaagtcatcatgccccttatgtcttgggctgcacacgtgctacaatggccggtacaatgagctgcgataccgcgaggtggagcgaatctcaaaaagccggtctcagttcggattggggtctgcaactcgaccccatgaagtcggagtcgctagtaatcgcagatcagcattgctgcggtgaatacgttcccgggccttgtacacaccgcccgtcacgtcacgaaagtcggtaacacccgaagccggtggcccaacccgtaagggagggaatcgtcgaaggtgggactggcgattgggacgaagtcgtaacaaggtagccgtaccggaaggtgcggctggatcacctcctttcta

SEQ ID NO: 9484 - DNA, 1526 bp, Streptosporangiaceae bacterium YIM 75507
  ref <308>: DATABASE ACCESSION NUMBER: NCBI ACCESSION: NZ_QZEY01000050.1
  ref <309>: DATABASE ENTRY DATE: 2019-04-01
  ref <313>: RELEVANT RESIDUES IN SEQ ID NO: (1)..(1526)
tgtttggagagtttgatcctggctcaggacgaacgctggcggcgtgcttaacacatgcaagtcgagcggaaaggcccttcggggtactcgagcggcgaacgggtgagtaacacgtgagtaacctgcccctgacttcgggataagcctgggaaaccgggtctaataccggatatgacctgccttcgcatgttggcgggtggaaagtttttcggttggggatgggctcgcggcctatcagcttgttggtggggtgatggcctaccaaggcgacgacgggtagccggcctgagagggcgaccggccacactgggactgagacacggcccagactcctacgggaggcagcagtggggaatattgcgcaatgggcgaaagcctgacgcagcgacgccgcgtgggggatgacggccttcgggttgtaaacctctttcagcggggacgaagccttcgggtgacgtgtactcgcagaagaagcgccggctaactacgtgccagcagccgcggtaatacgtagggcgcaagcgttgtccggaattattgggcgtaaagagctcgtaggtggtctgtcgcgtctgccgtgaaagcccgtggcttaactacgggtctgcggtggatacgggcagactagaggtaggtaggggagaacggaattcctggtgtagcggtgaaatgcgcagatatcaggaggaacaccggtggcgaaggcggttctctgggccttacctgacgctgaggagcgaaagcgtggggagcgaacaggattagataccctggtagtccacgccgtaaacgttgggcgctaggtgtggggtccttccacggattccgtgccgtagctaacgcattaagcgccccgcctggggagtacggccgcaaggctaaaactcaaaggaattgacgggggcccgcacaagcggcggagcatgttgcttaattcgacgcaacgcgaagaaccttaccaaggtttgacatacaccggaaagcctcagagatggggcccccttcgggtcggtgtacaggtggtgcatggctgtcgtcagctcgtgtcgtgagatgttgggttaagtcccgcaacgagcgcaacccttgttccatgttgccagcacgtagtggtggggactcatgggagactgccggggtcaactcggaggaaggtggggatgacgtcaagtcatcatgccccttatgtcttgggctgcaaacatgctacaatggccggtacaaagggctgctaaaccgtgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggcaacacccgaagcccgtggcctaacccgtaagggagggagcggtcgaaggtggggctggcgattgggacgaagtcgtaacaaggtagccgtaccggaaggtgcggctggatcacctcctttctaaggag

SEQ ID NO: 9485 - DNA, 1532 bp, Subdoligranulum sp. AF14-43
  ref <308>: DATABASE ACCESSION NUMBER: NCBI ACCESSION: NZ_QVGX01000053.1
  ref <309>: DATABASE ENTRY DATE: 2019-04-01
  ref <313>: RELEVANT RESIDUES IN SEQ ID NO: (1)..(1532)
tttaatgaagagtttgatcctggctcaggacgaacgctggcggcgcgcctaacacatgcaagtcgaacggagctgttttctctgaagttttcggatggaagagagttcagcttagtggcgaacgggtgagtaacacgtgagcaacctgcctttcagtgggggacaacatttggaaacgaatgctaataccgcataagaccacagtgtcgcatggcacaggggtcaaaggatttatccgctgaaagatgggctcgcgtccgattagctagatggtgaggtaacggcccaccatggcgacgatcggtagccggactgagaggttgaacggccacattgggactgagacacggcccagactcctacgggaggcagcagtggggaatattgcacaatgggggaaaccctgatgcagcgacgccgcgtggaggaagaaggtcttcggattgtaaactcctgtcccaggggacgataatgacggtaccctgggaggaagcaccggctaactacgtgccagcagccgcggtaaaacgtagggtgcaagcgttgtccggaattactgggtgtaaagggagcgcaggcggattggcaagttgggagtgaaatctatgggctcaacccataaattgctttcaaaactgtcagtcttgagtggtgtagaggtaggcggaattcccggtgtagcggtggaatgcgtagatatcgggaggaacaccagtggcgaaggcggcctactgggcactaactgacgctgaggctcgaaagcatgggtagcaaacaggattagataccctggtagtccatgccgtaaacgatgattactaggtgtgggaggattgaccccttccgtgccgcagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatcggatgcatacctaagagattagggaagtccttcgggacatccagacaggtggtgcatggttgtcgtcagctcgtgtcgtgagatgttgggttaagtcccgcaacgagcgcaacccttatcgttagttactacgcaagaggactctagcgagactgccgttgacaaaacggaggaaggtggggatgacgtcaaatcatcatgccctttatgacctgggctacacacgtactacaatggctattaacagagagaagcgataccgcgaggtggagcaaacctcacaaaaatagtctcagttcggatcgcaggctgcaacccgcctgcgtgaagccggaattgctagtaatcgcggatcagcatgccgcggtgaatacgttcccgggccttgtacacaccgcccgtcacaccatgagagccggggggacccgaagtcggtagtctaaccgtaaggaggacgccgccgaaggtaaaactggtgattggggtgaagtcgtaacaaggtagccgtatcggaaggtgcggctggatcacctcctttcta

SEQ ID NO: 9486 - DNA, 1532 bp, Subdoligranulum sp. AM16-9; identical to SEQ ID NO: 9485
  ref <308>: DATABASE ACCESSION NUMBER: NCBI ACCESSION: NZ_QVGL01000090.1
  ref <309>: DATABASE ENTRY DATE: 2019-04-01
  ref <313>: RELEVANT RESIDUES IN SEQ ID NO: (1)..(1532)

SEQ ID NO: 9487 - DNA, 1532 bp, Subdoligranulum sp. AM23-21AC
  ref <308>: DATABASE ACCESSION NUMBER: NCBI ACCESSION: NZ_QVGK01000064.1
  ref <309>: DATABASE ENTRY DATE: 2019-04-01
  ref <313>: RELEVANT RESIDUES IN SEQ ID NO: (1)..(1532)
tttaatgaagagtttgatcctggctcaggacgaacgctggcggcgcgcctaacacatgcaagtcgaacggagctgttttctctgaagttttcggatggaagagagttcagcttagtggcgaacgggtgagtaacacgtgagcaacctgcctttcagtgggggacaacatttggaaacgaatgctaataccgcataagaccacagtgtcgcatggcacaggggtcaaaggatttatccgctgaaagatgggctcgcgtccgattagctagatggtgaggtaacggcccaccatggcgacgatcggtagccggactgagaggttgaacggccacattgggactgagacacggcccagactcctacgggaggcagcagtggggaatattgcacaatgggggaaaccctgatgcagcgacgccgcgtggaggaagaaggtcttcggattgtaaactcctgtcccaggggacgataatgacggtaccctgggaggaagcaccggctaactacgtgccagcagccgcggtaaaacgtagggtgcaagcgttgtccggaattactgggtgtaaagggagcgcaggcggattggcaagttgggagtgaaatctatgggctcaacccataaattgctttcaaaactgtcagtcttgagtggtgtagaggtaggcggaattcccggtgtagcggtggaatgcgtagatatcgggaggaacaccagtggcgaaggcggcctactgggcactaactgacgctgaggctcgaaagcatgggtagcaaacaggattagataccctggtagtccatgccgtaaacgatgattactaggtgtgggaggattgaccccttccgtgccgcagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatcggatgcatacctaagagattagggaagtccttcgggacatccagacaggtggtgcatggttgtcgtcagctcgtgtcgtgagatgttgggttaagtcccgcaacgagcgcaacccttatcgttagttactacgcaagaggactctagcgagactgccgttgacaaaacggaggaaggtggggatgacgtcaaatcatcatgccctttatgacctgggctacacacgtactacaatggctattaacagagagaagcgataccgcgaggtggagcaaacctcacaaaaatagtctcagttcggatcgcaggctgcaacccgcctgcgtgaagccggaattgctagtaatcgcggatcagcatgccgcggtgaatacgttcccgggccttgtacacaccgcccgtcacaccatgagagccggggggacccgaagtcggtagtctaaccgcaaggaggacgccgccgaaggtaaaactggtgattggggtgaagtcgtaacaaggtagccgtatcggaaggtgcggctggatcacctcctttcta

SEQ ID NO: 9488 - DNA, 1516 bp, Subdoligranulum sp. APC924 74
  ref <308>: DATABASE ACCESSION NUMBER: NCBI ACCESSION: NZ_PSQF01000141.1
  ref <309>: DATABASE ENTRY DATE: 2019-04-01
  ref <313>: RELEVANT RESIDUES IN SEQ ID NO: (1)..(1516)
tttataaagagtttgatcctggctcaggacgaacgctggcggcgcgcctaacacatgcaagtcgaacggagcttagagggcttgctttttaagcttagtggcgaacgggtgagtaacgcgtgagtaacctgccctggagtgggggacaacagttggaaacgactgctaataccgcataagcccacggtaccgcatggtactgagggaaaaggatttattcgctttaggatggactcgcgtccaattagctagttggtgaggtaacggcccaccaaggcgacgattggtagccggactgagaggttgaacggccacattgggactgagacacggcccagactcctacgggaggcagcagtgggggatattgcacaatgggggaaaccctgatgcagcgacgccgcgtggaggaagaaggttttcggattgtaaactcctgtcgttagggacgataatgacggtacctaacaagaaagcaccggctaactacgtgccagcagccgcggtaaaacgtagggtgcaagcgttgtccggaattactgggtgtaaagggagcgcaggcgggaagacaagttggaagtgaaaaccatgggctcaacccatgaattgctttcaaaactgtttttcttgagtagtgcagaggtagatggaattcccggtgtagcggtggaatgcgtagatatcgggaggaacaccagtggcgaaggcggtctactgggcaccaactgacgctgaggctcgaaagcatgggtagcaaacaggattagataccctggtagtccatgccgtaaacgatgattactaggtgttgggggattgaccccctcagtgccgcagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatccgatgcatagcacagagatgtgtgaaatccttcgggacatcgagacaggtggtgcatggttgtcgtcagctcgtgtcgtgagatgttgggttaagtcccgcaacgagcgcaacccttattgccagttactacgttaagaggactctggcgagactgccgttgacaaaacggaggaaggtggggatgacgtcaaatcatcatgccctttatgacctgggctacacacgtactacaatggcgttaaacaaagagaagcaagaccgcgaggtggagcaaaactcaaaaacaacgtctcagttcagattgcaggctgcaactcgcctgcatgaagtcggaattgctagtaatcgcggatcagcatgccgcggtgaatacgttcccgggccttgtacacaccgcccgtcacaccatgagagccggggggacccgaagtcgatagtctaaccgcaaggaggacgtcgccgaaggtaaaactggtgattggggtgaagtcgtaacaaggtagccgtatcggaaggtgcggctggatcacctcctttcta

SEQ ID NO: 9489 - DNA, 1532 bp, Subdoligranulum sp. OF01-18; identical to SEQ ID NO: 9485
  ref <308>: DATABASE ACCESSION NUMBER: NCBI ACCESSION: NZ_QVGP01000001.1
  ref <309>: DATABASE ENTRY DATE: 2019-04-01
  ref <313>: RELEVANT RESIDUES IN SEQ ID NO: (1)..(1532)

SEQ ID NO: 9490 - DNA, 1532 bp, Subdoligranulum sp. TF05-17AC; identical to SEQ ID NO: 9487
  ref <308>: DATABASE ACCESSION NUMBER: NCBI ACCESSION: NZ_QVHL01000041.1
  ref <309>: DATABASE ENTRY DATE: 2019-04-01
  ref <313>: RELEVANT RESIDUES IN SEQ ID NO: (1)..(1532)

SEQ ID NO: 9491 - DNA, 1529 bp, Subtercola boreus
  ref <308>: DATABASE ACCESSION NUMBER: NCBI ACCESSION: NZ_NBWZ01000001.1
  ref <309>: DATABASE ENTRY DATE: 2019-04-01
  ref <313>: RELEVANT RESIDUES IN SEQ ID NO: (1)..(1529)
tttacggagagtttgatcctggctcaggacgaacgctggcggcgtgcttaacacatgcaagtcgaacgatgaagaggtgcttgcatcttggattagtggcgaacgggtgagtaacacgtgagtaacctgcccttgactctgggataagcgttggaaacgacgtctaataccggatatgacgactgaacgcctgttctggttgtggaaagattttttggtcaaggatggactcgcggcctatcaggttgttggtgaggtaatggctcaccaagcctacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtaaggaagaagaacttcggtttgacggtacttgcagaaaaagcaccggctaactacgtgccagcagccgcggtaatacgtagggtgcaagcgttgtccggaattattgggcgtaaagagctcgtaggcggtttgtcgcgtctgctgtgaaatctggaggctcaacctccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggaactagatgtagggaccattccacggtttctgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatgaacgagaacgggtcagaaatgatcaactctttggacactcgtttacaggtggtgcatggttgtcgtcagctcgtgtcgtgagatgttgggttaagtcccgcaacgagcgcaaccctcgttctatgttgccagcacgttatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccaacgccagtggcctaaccttcgggagggagctgtctaaggtgggattggtgattaggactaagtcgtaacaaggtagccgtaccggaaggtgcggctggatcacctcctttcta

SEQ ID NO: 9492 - DNA, 1528 bp, Subtercola sp. Z020
  ref <308>: DATABASE ACCESSION NUMBER: NCBI ACCESSION: NZ_PSTT01000136.1
  ref <309>: DATABASE ENTRY DATE: 2019-04-01
  ref <313>: RELEVANT RESIDUES IN SEQ ID NO: (1)..(1528)
tttacggagagtttgatcctggctcaggacgaacgctggcggcgtgcttaacacatgcaagtcgaacgatgatgccagcttgctggtggattagtggcgaacgggtgagtaacacgtgagtaacctgcccttgactctgggataagcgttggaaacgacgtctaataccggatatgacagccgatcgcatggtctggttgtggaaagaattttggtcaaggatggactcgcggcctatcaggttgttggtgaggtaatggctcaccaagcctacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtaaggaagaagaacttcggtttgacggtacttgcagaaaaagcaccggctaactacgtgccagcagccgcggtaatacgtagggtgcaagcgttgtccggaattattgggcgtaaagagctcgtaggcggtttgtcgcgtctgctgtgaaatctggaggctcaacctccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggaactagatgtaggggccattccacggtttctgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacctgcagaaatgtaggccccgcaaggtcggtatacaggtggtgcatggttgtcgtcagctcgtgtcgtgagatgttgggttaagtcccgcaacgagcgcaaccctcgttctatgttgccagcacgttatggtgggaactcataggagactgccggggtcaactcggaggaaggtggggatgacgtcaaatcatcatgccccttatgtcttgggcttcacgcatgctacaatggccggtacaaagggcggcaataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcccaaccgtaaggggggagctgtcgaaggtgggatcggtgattaggactaagtcgtaacaaggtagccgtaccggaaggtgcggctggatcacctcctttctaagga

SEQ ID NO: 9493 - DNA, 1568 bp, Succinispira mobilis
  ref <308>: DATABASE ACCESSION NUMBER: NCBI ACCESSION: NZ_KB913028.1
  ref <309>: DATABASE ENTRY DATE: 2019-04-01
  ref <313>: RELEVANT RESIDUES IN SEQ ID NO: (1)..(1568)
atatattggagagtttgatcctggctcaggacgaacgctggcggcgtgcctaacacatgcaagtcgaacggagaattagcaataattcttagtggcgaacgggtgagtaacgcgtgggcaatctgccctctagatggggacaacattccgaaaggagtgctaataccgaatgtgttcagtaagttgcatagtttgctgaagaaagatggcctctatttataagctatcgctagaggatgagcctgcgtctgattagctagttggtgaggtaatggctcaccaaggcgacgatcagtagccggtctgagaggatgaacggccacactgggactgagacacggcccagactcctacgggaggcagcagtggggaatcttccgcaatggacgaaagtctgacggagcaacgccgcgtgaacgaagaaggccttcgggtcgtaaagttctgttgttagggaagaatgtgcttcttgtaaataatgagaagtaatgacggtacctaaagaggaagccacggctaactacgtgccagcagccgcggtaatacgtaggtggcgagcgttgtccggaattattgggcgtaaagagcatgtaggtgggaatgtaagtctgttgttaaatggcggggcttcaccccgtattgcactggaaactacatttcttgagtgcaggagaggaaagggggaattcccagtgtagcggtgaaatgcgtagatattgggaggaacaccagtggccgaaggcgcctttctggactgtgtctgacactgagatgcgaaagctaggggagcgaacgggattagataccccggtagtcctagccgtaaacgatgggtactgagtgtgagggaggtatcgaccccttctgtgccggagttaacgcaataagtaccccgccctgggagtacggccgcaaggttgaaactcaaaggaattgacgggggccccgcacaagcggtggagtatgtggtttaattcgacgcaaccgcgaagaaccttaccaaggcttggacatcaactgaaagatatagagatatatccctctcttcggagacaggaagacaggtggtgcatggctgtcgtcagctcgtgtcgtgagatgttgggttaagtcccgcaacgagcgcaacccctatcctatgttgccagcattaagttggggactcatgggagactgccagggacaacctggaggaaggcggggatgacgtcaagtcatcatgccccttatgccttgggctacacacgtactacaatggttggaaacagagggcagcgagaccgcaaggtggagcaaatcccagaaacccaatctcagttcggattgtgggctgaaactcgcccacatgaagttggaatcgctagtaatcgcaggtcagcatactgcggtgaatacgttcccgggccttgtacacaccgcccgtcacaccacgaaagttgattacacccgaagtcggtgaggtaaccgtaaggagccagccgcctaaggtggggtcgatgattggggtgaagtcgtaacaaggtagccgtatcggaaggtgcggctggatcacctcctttctatggaga

SEQ ID NO: 9494 - DNA, 1555 bp, Sulfitobacter donghicola
  ref <308>: DATABASE ACCESSION NUMBER: NCBI ACCESSION: NZ_CP026367.1
  ref <309>: DATABASE ENTRY DATE: 2019-04-01
  ref <313>: RELEVANT RESIDUES IN SEQ ID NO: (1)..(1555)
tttatggagagtttgatcctggctcaggatgaacgctggcggcgtgcctaatacatgcaagtcgagcgaacagataaggagcttgctcctttgacgttagcggcggacgggtgagtaacacgtggataacctacctataagactgggataacttcgggaaaccggagctaataccggataacatattgaaccgcatggttcaatagtgaaaggcggctttgctgtcacttatagatggatccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttatcagggaagaacaaatgtgtaagtaactgtgcacatcttgacggtacctgatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagctaaaccgtgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcgaaggtgggacaaatgattggggtgaagtcgtaacaaggtagccgtatcggaaggtgcggctggatcacctcctttct

SEQ ID NO: 9495 - DNA, 1469 bp, Sulfitobacter geojensis
  ref <308>: DATABASE ACCESSION NUMBER: NCBI ACCESSION: NZ_LXYM01000032.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcacccttcggggcgagcggcggacgggttagtaacgcgtgggaacatacctttcactacggaatagcctcgggaaactgagagtaataccgtatacgcccttcgggggaaagatttatcggtgaaagattggcccgcgtaagattagatagttggtggggtaatggcctaccaagtctacgatctttagctggttttagaggatgatcagcaacactgggactgagacacggcccagactcctacgggaggcagcagtggggaatcttagacaatgggcgcaagcctgatctagccatgccgcgtgtgtgatgaaggccttagggtcgtaaagcactttcgctagggatgataatgacagtacctagtaaagaaaccccggctaactccgtgccagcagccgcggtaatacggagggggttagcgttgttcggaattactgggcgtaaagcgtacgtaggcggatcagaaagtagggggtgaaatcccgaggctcaacctcggaactgcctcctaaactcctggtcttgagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgccactaccagagatggtacgttcccttcggggacgcagtgacaggtgctgcatggctgtcgtcagctcgtgtcgtgagatgttcggttaagtccggcaacgagcgcaacccacatctttagttgccagcagttcggctgggcactctaaagaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttcggggaggcaggcggccacggtaggatcagcgactggggtgaagtcgtaacaaggtagccgtaggggaacctgcggctggatcacctcctttctaa

SEQ ID NO: 9496 - DNA, 1468 bp, Sulfitobacter guttiformis
  ref <308>: DATABASE ACCESSION NUMBER: NCBI ACCESSION: NZ_RAQK01000001.1
  ref <309>: DATABASE ENTRY DATE: 2019-04-01
  ref <313>: RELEVANT RESIDUES IN SEQ ID NO: (1)..(1468)
tcaacttgagagtttgatcctggctcagaacgaacgctggcggcaggcctaacacacgcaagtcgagcgcacccttcggggcgagcggcggacgggttagtaacgcgtgggaacataccctttactacggaatagcctcgggaaactgagagtaataccgtatgtgcccttcgggggaaagatttatcggtaaaggattggcccgcgtaagattagatagttggtggggtaatggcctaccaagtctacgatctttagctggttttagaggatgatcagcaacactgggactgagacacggcccagactcctacgggaggcagcagtggggaatcttagacaatgggcgcaagcctgatctagccatgccgcgtgtgtgatgaaggccttagggtcgtaaagcactttcgctagggatgataatgacagtacctagtaaagaaaccccggctaactccgtgccagcagccgcggtaatacggagggggttagcgttgttcggaattactgggcgtaaagcgtacgtaggcggatcagaaagtaaggggtgaaatcccagggctcaaccctggaactgcctcttaaactcctggtcttgagttcgagagaggtgagtggaattccgagtgtagaggtgaaattcgtagatattcggaggaacaccagtggcgaaggcggctcactggctcgatactgacgctgaggtacgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctaacccgagagatcgggcgttcacttcggtgacgcagtgacaggtgctgcatggctgtcgtcagctcgtgtcgtgagatgttcggttaagtccggcaacgagcgcaacccacatctttagttgccatcatttagttgggcactctaaagaaactgcccgtgataagcgggaggaaggtgtggatgacgtcaagtcctcatggcccttacgggttgggctacacacgtgctacaatggcatttacaatgggttaatccccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgccaacccgtaagggaggcagcggaccacggtaggatcagcgactggggtgaagtcgtaacaaggtagccgtaggggaacctgcggctggatcacctcctttctaa

SEQ ID NO: 9497 - DNA, 1469 bp, Sulfitobacter indolifex
  ref <308>: DATABASE ACCESSION NUMBER: NCBI ACCESSION: NZ_ABID01000006.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgagaccttcgggtctagcggcggacgggttagtaacgcgtgggaacgtacccttctctgcggaatagccactggaaacggtgagtaataccgcatacgcccttcgggggaaagatttatcggagaaggatcggcccgcgttagattagatagttggtggggtaatggcctaccaagtctacgatctatagctggttttagaggatgatcagcaacactgggactgagacacggcccagactcctacgggaggcagcagtggggaatcttagacaatgggcgcaagcctgatctagccatgccgcgtgtgtgatgaaggtcttaggatcgtaaagcactttcgccagggatgataatgacagtacctggtaaagaaaccccggctaactccgtgccagcagccgcggtaatacggagggggttagcgttgttcggaattactgggcgtaaagcgtacgtaggcggatcagaaagtaaggggtgaaatcccagggctcaaccctggaactgcctcttaaactcctggtcttgagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctaacccgagagatcgggcgttcacttcggtgacgcagtgacaggtgctgcatggctgtcgtcagctcgtgtcgtgagatgttcggttaagtccggcaacgagcgcaacccacatccttagttgccagcagttcggctgggcactctaaggaaactgcccgtgataagcgggaggaaggtgtggatgacgtcaagtcctcatggcccttacgggttgggctacacacgtgctacaatggcagtgacaatgggttaatccccaaaagctgtctcagttcggattggggtctgcaactcgaccccatgaagtcggaatcgctagtaatcgtggaacagcatgccacggtgaatacgttcccgggccttgtacacaccgcccgtcacaccatgggagttggttctacccgacggccgtgcgccaacctttcgaggaggcagcggaccacggtaggatcagcgactggggtgaagtcgtaacaaggtagccgtaggggaacctgcggctggatcacctcctttctaa

SEQ ID NO: 9498 - DNA, 1470 bp, Sulfitobacter marinus
  ref <308>: DATABASE ACCESSION NUMBER: NCBI ACCESSION: NZ_FPAJ01000009.1
  ref <309>: DATABASE ENTRY DATE: 2019-04-01
  ref <313>: RELEVANT RESIDUES IN SEQ ID NO: (1)..(1470)
tcaacttgagagtttgatcctggctcagaacgaacgctggcggcaggcctaacacatgcaagtcgagcgcagtccttcgggaccgagcggcggacgggttagtaacgcgtgggaacatacccttttctacggaatagcctcgggaaactgagagtaataccgtataagcccttcgggggaaagatttatcgggaaaggattggcccgcgttagattagatagttggtggggtaacggcctaccaagtctacgatctatagctggttttagaggatgatcagcaacactgggactgagacacggcccagactcctacgggaggcagcagtggggaatcttagacaatgggcgcaagcctgatctagccatgccgcgtgtgtgatgaaggtcttaggatcgtaaagcactttcgccagggatgataatgacagtacctggtaaagaaaccccggctaactccgtgccagcagccgcggtaatacggagggggttagcgttgttcggaattactgggcgtaaagcgtacgtaggcggatcagaaagtagggggtgaaatcccagggctcaaccctggaactgcctcctaaactcctggtcttgagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctaactcgagagatcgagcgttcacttcggtgacgcagtgacaggtgctgcatggctgtcgtcagctcgtgtcgtgagatgttcggttaagtccggcaacgagcgcaacccacatccttagttgccagcaggttaagctgggcactctagggaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaaccttcggggggcaggcggccacggtaggatcagcgactggggtgaagtcgtaacaaggtagccgtaggggaacctgcggctggatcacctcctttctaa

SEQ ID NO: 9499 - DNA, 1467 bp, Sulfitobacter mediterraneus
  ref <308>: DATABASE ACCESSION NUMBER: NCBI ACCESSION: NZ_QBKU01000026.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcacccttcggggcgagcggcggacgggttagtaacgcgtgggaacatacccttttctacggaatagcctcgggaaactgagagtaataccgtatacgcccttcgggggaaagatttatcggagaaggattggcccgcgttagattagatagttggtggggtaacggcctaccaagtctacgatctatagctggttttagaggatgatcagcaacactgggactgagacacggcccagactcctacgggaggcagcagtggggaatcttagacaatgggcgcaagcctgatctagccatgccgcgtgtgtgatgaaggccttagggtcgtaaagcactttcgccagggatgataatgacagtacctggtaaagaaaccccggctaactccgtgccagcagccgcggtaatacggagggggttagcgttgttcggaattactgggcgtaaagcgtacgtaggcggatcagaaagtagggggtgaaatcccagggctcaaccctggaactgcctcctaaactcctggtcttgagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctaacccgagagatcgggcgttcacttcggtgacgcagtgacaggtgctgcatggctgtcgtcagctcgtgtcgtgagatgttcggttaagtccggcaacgagcgcaacccacatctttagttgccatcagttcggctgggcactctaaagaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaaccttcggggggcaggcggccacggtaggatcagcgactggggtgaagtcgtaacaaggtagccgtaggggaacctgcggctggatcacctcctttctaa

SEQ ID NO: 9500 - DNA, 1465 bp, Sulfitobacter noctilucae
  ref <308>: DATABASE ACCESSION NUMBER: NCBI ACCESSION: NZ_JASC01000002.1
  ref <309>: DATABASE ENTRY DATE: 2019-04-01
  ref <313>: RELEVANT RESIDUES IN SEQ ID NO: (1)..(1465)
tcaacttgagagtttgatcctggctcagaacgaacgctggcggcaggcctaacacatgcaagtcgagcgcaccttcgggtgagcggcggacgggttagtaacgcgtgggaacatacccttcactatggaatagccattggaaacgatgagtaataccatatacgcccttcgggggaaagatttatcggtgaaggattggcccgcgttagattagatagttggtggggtaatggcctaccaagtctacgatctatagctggttttagaggatgatcagcaacactgggactgagacacggcccagactcctacgggaggcagcagtggggaatcttagacaatgggcgcaagcctgatctagccatgccgcgtgtgtgatgaaggccttagggtcgtaaagcactttcgccagagatgataatgacagtatctggtaaagaaaccccggctaactccgtgccagcagccgcggtaatacggagggggttagcgttgttcggaattactgggcgtaaagcgtacgtaggcggatcagaaagtatagggtgaaatcccgaggctcaacctcggaactgccttgtaaactcctggtcttgagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgccactaccagagatggtacgttcccttcggggacgcagtgacaggtgctgcatggctgtcgtcagctcgtgtcgtgagatgttcggttaagtccggcaacgagcgcaacccacatctttagttgccatcagttcggctgggcactctaaagaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaaccttcgggaggcaggcggccacggtaggatcagcgactggggtgaagtcgtaacaaggtagccgtaggggaacctgcggctggatcacctcctttctaa

SEQ ID NO: 9501 - DNA, 1467 bp, Sulfitobacter noctilucicola
  ref <308>: DATABASE ACCESSION NUMBER: NCBI ACCESSION: NZ_JASD01000008.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcacccttcggggcgagcggcggacgggttagtaacgcgtgggaacgtacccttgtctacggaatagccattggaaacgatgagtaataccgtatacgcccttcgggggaaagatttatcggacaaggatcggcccgcgttagattagatagttggtggggtaatggcctaccaagtctacgatctatagctggttttagaggatgatcagcaacactgggactgagacacggcccagactcctacgggaggcagcagtggggaatcttagacaatgggcgcaagcctgatctagccatgccgcgtgtgtgatgaaggccttagggtcgtaaagcactttcgccagagatgataatgacagtatctggtaaagaaaccccggctaactccgtgccagcagccgcggtaatacggagggggttagcgttgttcggaattactgggcgtaaagcgtacgtaggcggatcagaaagtagggggtgaaatcccgaggctcaacctcggaactgcctcctaaactcctggtcttgagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgccactaccagagatggtacgttcccttcggggacgcagtgacaggtgctgcatggctgtcgtcagctcgtgtcgtgagatgttcggttaagtccggcaacgagcgcaacccacatctttagttgccatcagttcggctgggcactctaaagaaactgcccgtgataagcgggaggaaggtgtggatgacgtcaagtcctcatggcccttacgggttgggctacacacgtgctacaatggcagtgacaatgggttaatccccaaaagctgtctcagttcggattggggtctgcaactcgaccccatgaagtcggaatcgctagtaatcgtgtaacagcatgacacggtgaatacgttcccgggccttgtacacaccgcccgtcacaccatgggagttggttctacccgacgacgctgcgctaaccttcggggggcaggcggccacggtaggatcagcgactggggtgaagtcgtaacaaggtagccgtaggggaacctgcggctggatcacctcctttctaa

SEQ ID NO: 9502 - DNA, 1465 bp, Sulfitobacter pontiacus
  ref <308>: DATABASE ACCESSION NUMBER: NCBI ACCESSION: NZ_FNNB01000021.1
  ref <309>: DATABASE ENTRY DATE: 2019-04-01
  ref <313>: RELEVANT RESIDUES IN SEQ ID NO: (1)..(1465)
tcaacttgagagtttgatcctggctcagaacgaacgctggcggcaggcctaacacatgcaagtcgagcgcaccttcgggtgagcggcggacgggttagtaacgcgtgggaacatacccttttctacggaatagcctcgggaaactgagagtaataccgtataagcccttcgggggaaagatttatcgggaaaggattggcccgcgttagattagatagttggtggggtaatggcctaccaagtctacgatctatagctggttttagaggatgatcagcaacactgggactgagacacggcccagactcctacgggaggcagcagtggggaatcttagacaatgggcgcaagcctgatctagccatgccgcgtgtgtgatgaaggtcttaggatcgtaaagcactttcgccagggatgataatgacagtacctggtaaagaaaccccggctaactccgtgccagcagccgcggtaatacggagggggttagcgttgttcggaattactgggcgtaaagcgtacgtaggcggattggaaagttgggggtgaaatcccagggctcaaccctggaactgcctccaaaactatcagtctagagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctaacccgagagatcgggcgttcacttcggtgacgcagtgacaggtgctgcatggctgtcgtcagctcgtgtcgtgagatgttcggttaagtccggcaacgagcgcaacccacatccttagttgccagcagttcggctgggcactctaaggaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaaccttcggggggcaggcggccacggtaggatcagcgactggggtgaagtcgtaacaaggtagccgtaggggaacctgcggctggatcacctcctttctaa

SEQ ID NO: 9503 - DNA, 1467 bp, Sulfitobacter pseudonitzschiae
  ref <308>: DATABASE ACCESSION NUMBER: NCBI ACCESSION: NZ_FQVP01000024.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcacccttcggggcgagcggcggacgggttagtaacgcgtgggaatgtacccttctctatggaatagcctcgggaaactgagagtaataccatatacgcccttcgggggaaagatttatcggagaaggatcagcccgcgtaagattagatagttggtggggtaatggcctaccaagtctacgatctttagctggttttagaggatgatcagcaacactgggactgagacacggcccagactcctacgggaggcagcagtggggaatcttagacaatgggcgcaagcctgatctagccatgccgcgtgtgtgatgaaggccttagggtcgtaaagcactttcgccagggatgataatgacagtacctggtaaagaaaccccggctaactccgtgccagcagccgcggtaatacggagggggttagcgttgttcggaattactgggcgtaaagcgcacgtaggcggatcagaaagttgggggtgaaatcccggggctcaaccccggaactgcctccaaaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggacaactccagagatggagccttccttcgggacctagtgacaggtgctgcatggctgtcgtcagctcgtgtcgtgagatgttcggttaagtccggcaacgagcgcaacccacatctttagttgccagcagttcggctgggcactctaaagaaactgcccgtgataagcgggaggaaggtgtggatgacgtcaagtcctcatggcccttacgggttgggctacacacgtgctacaatggcatctacagtgggttaatccccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgccaacctttcgaggaggcagcggaccacggtaggatcagcgactggggtgaagtcgtaacaaggtagccgtaggggaacctgcggctggatcacctcctttctaa

SEQ ID NO: 9504 - DNA, 1467 bp, Sulfitobacter sp. 20 GPM-1509m; identical to SEQ ID NO: 9503
  ref <308>: DATABASE ACCESSION NUMBER: NCBI ACCESSION: NZ_JIBC01000004.1
  ref <309>: DATABASE ENTRY DATE: 2019-04-01
  ref <313>: RELEVANT RESIDUES IN SEQ ID NO: (1)..(1467)

SEQ ID NO: 9505 - DNA, 1465 bp, Sulfitobacter sp. AM1-D1
  ref <308>: DATABASE ACCESSION NUMBER: NCBI ACCESSION: NZ_CP018076.1
  ref <309>: DATABASE ENTRY DATE: 2019-04-01
  ref <313>: RELEVANT RESIDUES IN SEQ ID NO: (1)..(1465)
tcaacttgagagtttgatcctggctcagaacgaacgctggcggcaggcctaacacatgcaagtcgagcgcaccttcgggtgagcggcggacgggttagtaacgcgtgggaacgtacccttctctacggaatagccattggaaacgatgagtaataccgtatacgcccttcgggggaaagatttatcggagaaggatcggcccgcgttagattagatagttggtggggtaatggcctaccaagtctacgatctatagctggttttagaggatgatcagcaacactgggactgagacacggcccagactcctacgggaggcagcagtggggaatcttagacaatgggcgaaagcctgatctagccatgccgcgtgtgtgatgaaggccctagggtcgtaaagcactttcgccagggatgataatgacagtacctggtaaagaaaccccggctaactccgtgccagcagccgcggtaatacggagggggttagcgttgttcggaattactgggcgtaaagcgcacgtaggcggatcagaaagttgggggtgaaatcccagggctcaaccctggaactgccttcaaaactcctggtctagagttcgagagaggtgagtggaattccaagtgtagaggtgaaattcgtagatatttggaggaacaccagtggcgaaggcggctcactggctcgatactgacgctgaggtgcgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgccactccgagagatcggacgttcccttcggggacgcagtgacaggtgctgcatggctgtcgtcagctcgtgtcgtgagatgttcggttaagtccggcaacgagcgcaacccacatctttagttgccagcagttcggctgggcactctaaagaaactgcccgtgataagcgggaggaaggtgtggatgacgtcaagtcctcatggcccttacgggttgggctacacacgtgctacaatggtagtgacaatgggttaatcccaaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaaccttcgggaggcaggcggccacggtaggatcagcgactggggtgaagtcgtaacaaggtagccgtaggggaacctgcggctggatcacctcctttctaa

SEQ ID NO: 9506 - DNA, 1469 bp, Sulfitobacter sp. D7
  ref <308>: DATABASE ACCESSION NUMBER: NCBI ACCESSION: NZ_CP020694.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgagaccttcgggtctagcggcggacgggttagtaacgcgtgggaacgtgcccttctctgcggaatagccactggaaacggtgagtaataccgcatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttagacaatgggcgcaagcctgatctagccatgccgcgtgtgtgatgaaggtcttaggatcgtaaagcactttcgccagggatgataatgacagtacctggtaaagaaaccccggctaactccgtgccagcagccgcggtaatacggagggggttagcgttgttcggaattactgggcgtaaagcgtacgtaggcggatcagaaagttgggggtgaaatcccggggctcaaccccggaactgcctccaaaactcctggtcttgagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctaacccgagagatcgggcgtccacttcggtggcgcagtgacaggtgctgcatggctgtcgtcagctcgtgtcgtgagatgttcggttaagtccggcaacgagcgcaacccacatccttagttgccagcagttcggctgggcactctaaggaaactgcccgtgataagcgggaggaaggtgtggatgacgtcaagtcctcatggcccttacgggttgggctacacacgtgctacaatggcagtgacaatgggttaatccccaaaagctgtctcagttcggattggggtctgcaactcgaccccatgaagtcggaatcgctagtaatcgtggaacagcatgccacggtgaatacgttcccgggccttgtacacaccgcccgtcacaccatgggagttggttctacccgacggccgtgcgccaacccttcggggaggcagcggaccacggtaggatcagcgactggggtgaagtcgtaacaaggtagccgtaggggaacctgcggctggatcacctcctttctaa

SEQ ID NO: 9507 - DNA, 1467 bp, Sulfitobacter sp. DFL-14
  ref <308>: DATABASE ACCESSION NUMBER: NCBI ACCESSION: NZ_QBFD01000037.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcacccttcggggcgagcggcggacgggttagtaacgcgtgggaacgtacccttttctacggaatagcctcgggaaactgagagtaataccgtataagcccttcgggggaaagatttatcggtaaaggatcggcccgcgttagattagatagttggtggggtaatggcctaccaagtctacgatctatagctggttttagaggatgatcagcaacactgggactgagacacggcccagactcctacgggaggcagcagtggggaatcttagacaatgggcgcaagcctgatctagccatgccgcgtgtgtgatgaaggccttagggtcgtaaagcactttcgccagggatgataatgacagtacctggtaaagaaaccccggctaactccgtgccagcagccgcggtaatacggagggggttagcgttgttcggaattactgggcgtaaagcgtacgtaggcggatcagaaagtagggggtgaaatcccgaggctcaacctcggaactgcctcctaaactcctggtcttgagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctaacccgagagatcgggcgttcacttcggtgacgcagtgacaggtgctgcatggctgtcgtcagctcgtgtcgtgagatgttcggttaagtccggcaacgagcgcaacccacatctttagttgccagcagttcggctgggcactctaaagaaactgcccgtgataagcgggaggaaggtgtggatgacgtcaagtcctcatggcccttacgggttgggctacacacgtgctacaatggtagtgacaatgggttaatcccaaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaaccttcggggggcaggcggccacggtaggatcagcgactggggtgaagtcgtaacaaggtagccgtaggggaacctgcggctggatcacctcctttctaa

SEQ ID NO: 9508 - DNA, 1465 bp, Sulfitobacter sp. EE-36
  ref <308>: DATABASE ACCESSION NUMBER: NCBI ACCESSION: NZ_CH959310.1
  ref <309>: DATABASE ENTRY DATE: 2019-04-01
  ref <313>: RELEVANT RESIDUES IN SEQ ID NO: (1)..(1465)
tcaacttgagagtttgatcctggctcagaacgaacgctggcggcaggcctaacacatgcaagtcgagcgcaccttcgggtgagcggcggacgggttagtaacgcgtgggaacatacccttttctacggaatagcctcgggaaactgagagtaataccgtataagcccttcgggggaaagatttatcgggaaaggattggcccgcgttagattagatagttggtggggtaatggcctaccaagtctacgatctatagctggttttagaggatgatcagcaacactgggactgagacacggcccagactcctacgggaggcagcagtggggaatcttagacaatgggcgcaagcctgatctagccatgccgcgtgtgtgatgaaggtcttaggatcgtaaagcactttcgccagggatgataatgacagtacctggtaaagaaaccccggctaactccgtgccagcagccgcggtaatacggagggggttagcgttgttcggaattactgggcgtaaagcgtacgtaggcggattggaaagttgggggtgaaatcccagggctcaaccctggaactgcctccaaaactatcagtctagagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctaacccgagagatcgggcgttcacttcggtgacgcagtgacaggtgctgcatggctgtcgtcagctcgtgtcgtgagatgttcggttaagtccggcaacgagcgcaacccacatccttagttgccagcagttcggctgggcactctaaggaaactgcccgtgataagcgggaggaaggtgtggatgacgtcaagtcctcatggcccttacgggttgggctacacacgtgctacaatggcagtgacaatgggttaatccccaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaaccttcggggggcaggcggccacggtaggatcagcgactggggtgaagtcgtaacaaggtagccgtaggggaacctgcggctggatcacctcctttctaa

SEQ ID NO: 9509 - DNA, 1467 bp, Sulfitobacter sp. EL44; identical to SEQ ID NO: 9499
  ref <308>: DATABASE ACCESSION NUMBER: NCBI ACCESSION: NZ_OMPT01000003.1
  ref <309>: DATABASE ENTRY DATE: 2019-04-01
  ref <313>: RELEVANT RESIDUES IN SEQ ID NO: (1)..(1467)

SEQ ID NO: 9510 - DNA, 1467 bp, Sulfitobacter sp. EhC04
  ref <308>: DATABASE ACCESSION NUMBER: NCBI ACCESSION: NZ_LXYI01000035.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcacccttcggggcgagcggcggacgggttagtaacgcgtgggaacgtacccttttctacggaatagcctcgggaaactgagagtaataccgtataagcccttcgggggaaagatttatcgggaaaggatcggcccgcgttagattagatagttggtggggtaatggcctaccaagtctacgatctatagctggttttagaggatgatcagcaacactgggactgagacacggcccagactcctacgggaggcagcagtggggaatcttagacaatgggcgcaagcctgatctagccatgccgcgtgtgtgatgaaggccttagggtcgtaaagcactttcgccagggatgataatgacagtacctggtaaagaaaccccggctaactccgtgccagcagccgcggtaatacggagggggttagcgttgttcggaattactgggcgtaaagcgtacgtaggcggatcagaaagtagggggtgaaatcccgaggctcaacctcggaactgcctcctaaactcctggtcttgagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctaacccgagagatcgggtgttcacttcggtgacgcagtgacaggtgctgcatggctgtcgtcagctcgtgtcgtgagatgttcggttaagtccggcaacgagcgcaacccacatctttagttgccagcagttcggctgggcactctaaagaaactgcccgtgataagcgggaggaaggtgtggatgacgtcaagtcctcatggcccttacgggttgggctacacacgtgctacaatggtagtgacaatgggttaatcccaaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaaccttcggggggcaggcggccacggtaggatcagcgactggggtgaagtcgtaacaaggtagccgtaggggaacctgcggctggatcacctcctttctaa

SEQ ID NO: 9511 - DNA, 1469 bp, Sulfitobacter sp. HI0021
  ref <308>: DATABASE ACCESSION NUMBER: NCBI ACCESSION: NZ_LWEP01000526.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgagaccttcgggtctagcggcggacgggttagtaacgcgtgggaacgtgcccttctctgcggaatagccactggaaacggtgagtaataccgcatacgccctttgggggaaagatttatcggagaaggatcggcccgcgttagattagatagttggtggggtaatggcctaccaagtctacgatctatagctggttttagaggatgatcagcaacactgggactgagacacggcccagactcctacgggaggcagcagtggggaatcttagacaatgggcgcaagcctgatctagccatgccgcgtgtgtgatgaaggtcttaggatcgtaaagcactttcgccagggatgataatgacagtacctggtaaagaaaccccggctaactccgtgccagcagccgcggtaatacggagggggttagcgttgttcggaattactgggcgtaaagcgtacgtaggcggatcagaaagttgggggtgaaatcccggggctcaaccccggaactgcctccaaaactcctggtcttgagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctaacccgagagatcgggcgttcacttcggtgacgcagtgacaggtgctgcatggctgtcgtcagctcgtgtcgtgagatgttcggttaagtccggcaacgagcgcaacccacatccttagttgccagcagttcggctgggcactctaaggaaactgcccgtgataagcgggaggaaggtgtggatgacgtcaagtcctcatggcccttacgggttgggctacacacgtgctacaatggcagtgacaatgggttaatccccaaaagctgtctcagttcggattggggtctgcaactcgaccccatgaagtcggaatcgctagtaatcgtggaacagcatgccacggtgaatacgttcccgggccttgtacacaccgcccgtcacaccatgggagttggttctacccgacggccgtgcgccaacctttcgaggaggcagcggaccacggtaggatcagcgactggggtgaagtcgtaacaaggtagccgtaggggaacctgcggctggatcacctcctttctaa

SEQ ID NO: 9512 - DNA, 1465 bp, Sulfitobacter sp. HI0023
  ref <308>: DATABASE ACCESSION NUMBER: NCBI ACCESSION: NZ_LWEQ01000192.1
  ref <309>: DATABASE ENTRY DATE: 2019-04-01
  ref <313>: RELEVANT RESIDUES IN SEQ ID NO: (1)..(1465)
tcaacttgagagtttgatcctggctcagaacgaacgctggcggcaggcctaacacatgcaagtcgagcgcaccttcgggtgagcggcggacgggttagtaacgcgtgggaacgtgcccttctctacggaatagcctcgggaaactgagagtaataccgtatacgcccttcgggggaaagatttatcggagaaggatcggcccgcgttagattagatagttggtggggtaatggcctaccaagtctacgatctatagctggttttagaggatgatcagcaacactgggactgagacacggcccagactcctacgggaggcagcagtggggaatcttagacaatgggcgcaagcctgatctagccatgccgcgtgtgtgatgaaggtcttaggatcgtaaagcactttcgccagggatgataatgacagtacctggtaaagaaaccccggctaactccgtgccagcagccgcggtaatacggagggggttagcgttgttcggaattactgggcgtaaagcgtacgtaggcggatcagaaagttaggggtgaaatcccgaggctcaacctcggaactgcctctaaaactcctggtcttgagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctaacccgagagatcgggcgtccacttcggtggcgcagtgacaggtgctgcatggctgtcgtcagctcgtgtcgtgagatgttcggttaagtccggcaacgagcgcaacccacatccttagttgccagcagttcggctgggcactctaaggaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaaccttttggaggcagcggaccacggtaggatcagcgactggggtgaagtcgtaacaaggtagccgtaggggaacctgcggctggatcacctcctttctaa

SEQ ID NO: 9513 - DNA, 1469 bp, Sulfitobacter sp. HI0027; identical to SEQ ID NO: 9511
  ref <308>: DATABASE ACCESSION NUMBER: NCBI ACCESSION: NZ_LWER01000205.1
  ref <309>: DATABASE ENTRY DATE: 2019-04-01
  ref <313>: RELEVANT RESIDUES IN SEQ ID NO: (1)..(1469)

SEQ ID NO: 9514 - DNA, 1465 bp, Sulfitobacter sp. HI0040; identical to SEQ ID NO: 9512
  ref <308>: DATABASE ACCESSION NUMBER: NCBI ACCESSION: NZ_LWEX01000098.1
  ref <309>: DATABASE ENTRY DATE: 2019-04-01
  ref <313>: RELEVANT RESIDUES IN SEQ ID NO: (1)..(1465)

SEQ ID NO: 9515 - DNA, 1467 bp, Sulfitobacter sp. HI0054
  ref <308>: DATABASE ACCESSION NUMBER: NCBI ACCESSION: NZ_LWFD01000341.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgagaccttcgggtctagcggcggacgggttagtaacgcgtgggaacgtgcccttctctgcggaatagccactggaaacggtgagtaataccgcatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttagacaatgggcgcaagcctgatctagccatgccgcgtgtgtgatgaaggtcttaggatcgtaaagcactttcgccagggatgataatgacagtacctggtaaagaaaccccggctaactccgtgccagcagccgcggtaatacggagggggttagcgttgttcggaattactgggcgtaaagcgcgcgtaggcggattggaaagttgggggtgaaatcccggggctcaaccccggaactgcctccaaaactatcagtctagagttcgagagaggtgagtggaattccaagtgtagaggtgaaattcgtagatatttggaggaacaccagtggcgaaggcggctcactggctcgatactgacgctgaggtgcgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgccactccgagagatcggacgttcccttcggggacgcagtgacaggtgctgcatggctgtcgtcagctcgtgtcgtgagatgttcggttaagtccggcaacgagcgcaacccacatccttagttgccagcagttcggctgggcactctaaggaaactgcccgtgataagcgggaggaaggtgtggatgacgtcaagtcctcatggcccttacgggttgggctacacacgtgctacaatggcagtgacaatgggttaatccccaaaagctgtctcagttcggattggggtctgcaactcgaccccatgaagtcggaatcgctagtaatcgtggaacagcatgccacggtgaatacgttcccgggccttgtacacaccgcccgtcacaccatgggagttggttctacccgacggccgtgcgctaaccttttgggggcagcggaccacggtaggatcagcgactggggtgaagtcgtaacaaggtagccgtaggggaacctgcggctggatcacctcctttctaa

SEQ ID NO: 9516 - DNA, 1469 bp, Sulfitobacter sp. HI0076
  ref <308>: DATABASE ACCESSION NUMBER: NCBI ACCESSION: NZ_LWFQ01000663.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgagaccttcgggtctagcggcggacgggttagtaacgcgtgggaacgtgcccttctctgcggaatagccactggaaacggtgagtaataccgcatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttagacaatgggcgcaagcctgatctagccatgccgcgtgtgtgatgaaggtcttaggatcgtaaagcactttcgccagggatgataatgacagtacctggtaaagaaaccccggctaactccgtgccagcagccgcggtaatacggagggggttagcgttgttcggaattactgggcgtaaagcgtacgtaggcggatcagaaagttgggggtgaaatcccggggctcaaccccggaactgcctccaaaactcctggtcttgagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctaacccgagagatcgggcgttcacttcggtgacgcagtgacaggtgctgcatggctgtcgtcagctcgtgtcgtgagatgttcggttaagtccggcaacgagcgcaacccacatccttagttgccagcagttcggctgggcactctaaggaaactgcccgtgataagcgggaggaaggtgtggatgacgtcaagtcctcatggcccttacgggttgggctacacacgtgctacaatggcagtgacaatgggttaatccccaaaagctgtctcagttcggattggggtctgcaactcgaccccatgaagtcggaatcgctagtaatcgtggaacagcatgccacggtgaatacgttcccgggccttgtacacaccgcccgtcacaccatgggagttggttctacccgacggccgtgcgccaacctttcgaggaggcagcggaccacggtaggatcagcgactggggtgaagtcgtaacaaggtagccgtaggggaacctgcggctggatcacctcctttctaa

SEQ ID NO: 9517 - DNA, 1465 bp, Sulfitobacter sp. NAS-14.1; identical to SEQ ID NO: 9502
  ref <308>: DATABASE ACCESSION NUMBER: NCBI ACCESSION: NZ_CH959312.1
  ref <309>: DATABASE ENTRY DATE: 2019-04-01
  ref <313>: RELEVANT RESIDUES IN SEQ ID NO: (1)..(1465)

SEQ ID NO: 9518 - DNA, 1465 bp, Sulfitobacter sp. SK025; identical to SEQ ID NO: 9502
  ref <308>: DATABASE ACCESSION NUMBER: NCBI ACCESSION: NZ_CP025808.1
  ref <309>: DATABASE ENTRY DATE: 2019-04-01
  ref <313>: RELEVANT RESIDUES IN SEQ ID NO: (1)..(1465)

SEQ ID NO: 9519 - DNA, 1515 bp, Sulfuricurvum kujiense
  ref <308>: DATABASE ACCESSION NUMBER: NCBI ACCESSION: NC_014762.1
  ref <309>: DATABASE ENTRY DATE: 2019-04-01
  ref <313>: RELEVANT RESIDUES IN SEQ ID NO: (1)..(1515)
attatggagagtttgatcctggctcagagtgaacgctggcggcgtgcctaacacatgcaagtcgaacgatgattggagagcttgctcttcatgattagtggcgcacgggtgagtataccatagataatgtaccccttagtttgggatagccactggaaacggtgattaataccagatactccttcttgtcctaaggcaagtcgggaaagttttttcgctaagggatcagtctatgtcctatcagctagttggtgaggtaatggctcaccaaggctatgacgggtatctggtttgagaggatgatcagacacactggaactgagacacggtccagactcctacgggaggcagcagtgaggaatattgcacaatggaggaaactctgatgcagcaacgccgcgtggaggatgacgcatttcggtgtgtaaactccttttaagagggaagataatgacggtacctcttgaataagcaccggctaactccgtgccagcagccgcggtaatacggagggtgcaagcgttactcggaatcactgggcgtaaagggtgcgtaggctgacttttaagtcaggcgtgaaatccaatggcttaaccattgaactgcgcttgaaactgggagtctagagttcagaaggggcagatggaattagtggtgtaggggtaaaatccgtagatatcactaggaatatcaaaagcgaaggcgatctgctgggatgatactgacgctgaggcacgaaagcgtggggagcaaacaggattagataccctggtagtccacgccctaaacgatgaatgctagtcgtcggggagctcgtctcttcggtgatgcacttaacagattaagcattccgcctggggagtacggtcgcaagattaaaactcaaaggaatagacggggacccgcacaagtggtggagcatgtggtttaattcgaagatacacgaagaaccttacctggccttgacatggtaggaacccttaagagattagggggtgctagcttgctagaacctacacacaggtgctgcacggctgtcgtcagctcgtgtcgtgagatgttgggttaagtcccgcaacgagcgcaaccctcgtccttagttgctaacagttcggctgagcactctaaggagactgccttcgcaaggaggaggaaggtgaggacgacgtcaagtcatcatggcccttacggccagggctacacacgtgctacaatggggcgtacaaagagctgcaataccgcgaggtggagccaatctcttaaagcgtctctcagttcggattgttctctgcaactcgagaacatgaagctggaatcactagtaatcgtagatcagctatgctacggtgaatacgttcccgggtcttgtactcaccgcccgtcacaccatgggagttgatttcacccgaaatcgggatgccaaactggctaccgcttacggtggaattagcgactggggtgaagtcgtaacaaggtaaccgtaggagaacctgcggttggatcacctcctttcta

SEQ ID NO: 9520 - DNA, 1547 bp, Sulfuriferula multivorans
  ref <308>: DATABASE ACCESSION NUMBER: NCBI ACCESSION: NZ_BGOW01000023.1
  ref <309>: DATABASE ENTRY DATE: 2019-04-01
  ref <313>: RELEVANT RESIDUES IN SEQ ID NO: (1)..(1547)
attaaactgaagagtttgatcctggctcagattgaacgctggcggaatgctttacacatgcaagtcgaacggcagcacgggagcttgctcctggtggcgagtggcgaacgggtgagtaatacgtcggaacgtatccatgtaatgggggataacgcagcgaaagctgtgctaataccgcatacgccctacgggggaaagcaggggatcttcggaccttgcgttattggagcggccgacgtctgattagctagttggtggggtaaaggcctaccaaggcgacgatcagtagctggtctgagaggatgatcagccacactggaactgagacacggtccagactcctacgggaggcagcagtggggaattttggacaatgggcgcaagcctgatccagccattccgcgtgagtgaagaaggccttcgggttgtaaagctctttcagcagggaagaaacgatcttggctaatacctgagattaatgacggtacctgaagaagaagcaccggctaactacgtgccagcagccgcggtaatacgtagggtgcgagcgttaatcggaattactgggcgtaaagcgtgcgcaggcggtttttcaagtctgatgtgaaatccccgggcttaacctgggaactgcgttggaaactgaaagactagagtgcggcagaggggggtagaattccacgtgtagcagtgaaatgcgtagatatgtggaggaataccgatggcgaaggcagccccctgggtcgacactgacgctcatgcacgaaagcgtgggtagcaaacaggattagataccctggtagtccacgccctaaacgatgtcaactagttgttggggagggagacctccttagtaacgcagctaacgcgtgaagttgaccgcctggggagtacggtcgcaagattaaaactcaaaggaattgacgggggcccgcacaagcggtggattatgtggattaattcgatgcaacgcgaaaaaccttacctacccttgacatgtacggaacttgccagagatggcttggtgcttgaaagagaaccgtaacacaggtgctgcatggctgtcgtcagctcgtgtcgtgagatgttgggttaagtcccgcaacgagcgcaacccttgccattagttgctacattcagttgggcactctaatgggactgccggtgacaaaccggaggaaggtggggatgacgtcaagtcctcatggcccttatgggtagggcttcacacgtaatacaatggtcggtacagagggttgccaacccgcgagggggagccaatcccagaaagccgatcgtagtccggatcggagtctgcaactcgactccgtgaagtcggaatcgctagtaatcgcggatcagcatgtcgcggtgaatacgttcccgggccttgtacacaccgcccgtcacaccatgggagtgggtattaccagaagcaggtagcttaaccttcgggagggcgcttgccacggtaggattcatgactggggtgaagtcgtaacaaggtagccgtaggggaacctgcggctggatcacctcctttctag

SEQ ID NO: 9521 - DNA, 1544 bp, Sulfuriferula thiophila
  ref <308>: DATABASE ACCESSION NUMBER: NCBI ACCESSION: NZ_BHGL01000031.1
  ref <309>: DATABASE ENTRY DATE: 2019-04-01
  ref <313>: RELEVANT RESIDUES IN SEQ ID NO: (1)..(1544)
attaaactgaagagtttgatcctggctcagattgaacgctggcggaatgctttacacatgcaagtcgaacggcagcacggagcttgctctggtggcgagtggcgaacgggtgagtaatgcgtcggaacgtatccaataatgggggataacgcagcgaaagctgtgctaataccgcatacgccctgagggggaaagcaggggatcttcggaccttgcgttagtggagcggccgacgtctgattagctagttggtagggtaaaggcctaccaaggcgacgatcagtagctggtctgagaggatgatcagccacactggaactgagacacggtccagactcctacgggaggcagcagtggggaattttggacaatgggggaaaccctgatccagccattccgcgtgagtgaagaaggccttcgggttgtaaagctctttcaggagggaagaaacgatcatggttaataaccatgattaatgacggtaccttcagaagaagcaccggctaactacgtgccagcagccgcggtaatacgtagggtgcgagcgttaatcggaattactgggcgtaaagcgtgcgcaggcggtttatcaagtctgatgtgaaagccccgggcttaacctgggaactgcgttggaaactgataaactagagtacggcagaggggggtagaattccacgtgtagcagtgaaatgcgtagatatgtggaggaataccgatggcgaaggcagccccctgggtcgatactgacgctcatgcacgaaagcgtgggtagcaaacaggattagataccctggtagtccacgccctaaacgatgtcaactagttgttggggagggagacctccttagtaacgcagctaacgcgtgaagttgaccgcctggggagtacggtcgcaagattaaaactcaaaggaattgacgggggcccgcacaagcggtggattatgtggattaattcgatgcaacgcgaaaaaccttacctacccttgacatgtacggaacttgccagagatggcttggtgcttgaaagagaaccgtaacacaggtgctgcatggctgtcgtcagctcgtgtcgtgagatgttgggttaagtcccgcaacgagcgcaacccttgtcattaattgccatcatttagttgggcactttaatgagactgccggtgacaaaccggaggaaggtagggatgacgtcaagtcctcatggcccttatgggtagggcttcacacgtaatacaatggtcggtacagagggttgccaacccgcgagggggagctaatctcagaaagccgatcgtagtccggattgtagtctgcaactcgactgcatgaagtcggaatcgctagtaatcgcggatcagcatgtcgcggtgaatacgttcccgggccttgtacacaccgcccgtcacaccatgggagtgggtattaccagaagtaggtagcttaaccttcgggagagcgcttaccacggtaggattcatgactggggtgaagtcgtaacaaggtagccgtaggggaacctgcggctggatcacctcctttcta

SEQ ID NO: 9522 - DNA, 1544 bp, Sulfuriflexus mobilis
  ref <308>: DATABASE ACCESSION NUMBER: NCBI ACCESSION: NZ_AP018725.1
  ref <309>: DATABASE ENTRY DATE: 2019-04-01
  ref <313>: RELEVANT RESIDUES IN SEQ ID NO: (1)..(1544)
gaactgaagagtttgatcctggctcagattgaacgctggcggcatgcctaacacatgcaagtcgaacggcagcacgggaaagcttgctttcctggtggcgagtggcggacgggtgagtaacgcgtaggaatctgcctagtagttggggacaacctggtgaaaaccaggctaataccgaataagccctacgggggaaagtggaggatcttcggacttcacgctattagatgagcctgcgtcggattagcttgttggtgaggtaatggctcaccaaggcgacgatccgtagctggtctgagaggacgatcagccacactgggactgagacacggcccagactcctacgggaggcagcagtggggaatattggacaatgggggcaaccctgatccagcaatgccgcgtgtgtgaagaaggcctgcgggttgtaaagcactttcagtagggaggaaaagttcaaggttaatacccttggaccctgacgttacctacagaagaagcaccggctaactctgtgccagcagccgcggtaatacagagggtgcaagcgttaatcggaattactgggcgtaaagcgcgcgtaggcggtttagtaagtcggatgtgaaagccccgggctcaacctgggaattgcattcgatactgctagactagagtatggtagagggaagtggaatttcaggtgtagcggtgaaatgcgtagatatctgaaggaacatcagtggcgaaggcgacttcctggaccaatactgacgctgaggtgcgaaagcgtggggagcaaacaggattagataccctggtagtccacgccgtaaacgatgtcaactagccgttgggcctattaaaaggtttagtggcgcagctaacgcgataagttgaccgcctggggagtacggtcgcaagattaaaactcaaaggaattgacgggggcccgcacaagcggtggagcatgtggtttaattcgatgcaacgcgaagaaccttacctacccttgacatcatcggaacttgtcagagatgactcggtgccttcgggaaccgatagacaggtgctgcatggctgtcgtcagctcgtgtcgtgagatgttgggttaagtcccgtaacgagcgcaacccttgtccttagttgccatcattaagttgggcactctagggagactgccggtgacaaaccggaggaaggtggggatgacgtcaagtcatcatggcccttatgggtagggctacacacgtgctacaatggtcggtacagagggttgccaagccgcgaggtggagccaatcccagaaaaccggtcgtagtccggattggagtctgcaactcgactccatgaagtcggaatcgctagtaatcgcgaatcagaatgtcgcggtgaatacgttcccgggccttgtacacaccgcccgtcacaccatgggagtgggctgcaaaagaagtgggtagcataaccttcgggagtgcgctcaccactttgtggttcatgactggggtgaagtcgtaacaaggtagccctaggggaacctggggctggatcacctcctttaa

SEQ ID NO: 9523 - DNA, 1525 bp, Sulfurihydrogenibium azorense
  ref <308>: DATABASE ACCESSION NUMBER: NCBI ACCESSION: NC_012438.1
  ref <309>: DATABASE ENTRY DATE: 2019-04-01
  ref <313>: RELEVANT RESIDUES IN SEQ ID NO: (1)..(1525)
ttggagagtttgatcctggctcagcgcgaacgttggcggcgtgcctaacacatgcaagtcgtggggcagcaggctattaccttcgggtaatagtgctggcgaccggcaaacgggtgagtaacgcgtagctaacctacccataggttggggataaccatccgaaagggtggctaatacccaataatgaggagactccaaagcccttttgggcgcctatggatggggctgcgtcccatcagctagttggtgaggtaatggctcaccaaggctacgacgggtaaccggtctgagaggatgatcggtcacagcgggactgagacacggcccgcacccctacggggggcagcagtggggaatattgggcaatggccgaaaggctgacccagcaacgccgcgtggtggatgaagcccttcggggtgtaaacaccttttctgggggaagataatgacggtaccccaggaataagggacggctaactacgtgccagcagccgcggtaatacgtaggtcccgaacgttgcgcgaaattactgggcgtaaagggtccgtaggcggtctggtaagtggaaggtgaaatcctacggctcaaccgtagaattgccttccaaactgctggacttgaggcagggagaggtcggcggaattcccggtgtagcggtgaaatgcgtagatatcgggaggaacaccagtggcgaaggcggccgactggaactgtcctgacgctgagggacgaaagctaggggagcaaaccggattagatacccgggtagtcctagccgtaaacgatggatgctagatgtggcctacgaaagtaggctgtgccgcaagctaacgcgttaagcatcccgcctggggagtacggccgcaaggttgaaactcaaaggaattgacggggacccgcacaaccggtggagcgtctggtttaattcgatgctaaccgaaaaaccttaccagggtttgacatgcggtgtgtcgggtatgaaagtaccctaggctatgattattcatagccgcgccgcacaggtggtgcatggtcgtcgtcagctcgtgtcgtgagatgttgggttaagtcccgcaacgagcgcaacccttgccctgtgttaccagcgggtaaagccgggtactcacaggggactgccggcgataagtcggaggaaggaggggatgacgtcagatcagtatgccctttatgccctgggctacacaggcgctacagtggcagggacaatgggacgcaacgcagcaatgcggagcaaatcccctaaaccctgtcgtggtgcggattgggggttgcaactcacccccatgaaggcggaatcggtagtaatggcgaatcagcaatgtcgccgtgaatacgttcccgggtcttgtacacaccgcccgtcacgccatgggagtcgggttcatcggaagtccccgagctaacccgcaagggaggcaggggccgatgatgggcctgatgactggggcgaagtcgtaacaaggtagccctaggggaacctggggctggatcacctcctttata

SEQ ID NO: 9524 - DNA, 1527 bp, Sulfurihydrogenibium sp. YO3AOP1
  ref <308>: DATABASE ACCESSION NUMBER: NCBI ACCESSION: NC_010730.1
  ref <309>: DATABASE ENTRY DATE: 2019-04-01
  ref <313>: RELEVANT RESIDUES IN SEQ ID NO: (1)..(1527)
ttttggagagtttgatcctggctcagcgcgaacgttggcggcgtgcctaacacatgcaagtcgtggggcagcaggctactaccttcgggtagtagtgctggcgaccggcaaacgggtgagtaacacgtagcttacctacccataggttggggataacatcccgaaaggggtgctaatacccaataatgaggagactccaaagcccttatgggtgcctatggatggggctgcgtcccatcagcttgttggtgaggtaatggctcaccaaggctacgacgggtaaccggtctgagaggatgaccggtcacagtgggactgagacacggcccgcacccctacggggggcagcagtggggaatattgggcaatggccgaaaggctgacccagcaacgccgcgtggtggatgaagcccttcggggtgtaaacaccttttctgggggaagataatgacggtaccccaggaataagggacggctaactacgtgccagcagccgcggtaatacgtaggtcccgaacgttgcgcgaatttactgggcgtaaagggtccgtaggcggtttagcaagtggttggtgaaatttcacggctcaaccgtgaaactgccttccaaactgctaaacttgaggcagggagaggtcggcggaattcccggtgtagcggtgaaatgcgtagatatcgggaggaacaccagtggcgaaggcggccgactggaactgtcctgacgctgagggacgaaagctaggggagcaaaccggattagatacccgggtagtcctagccgtaaacgatggatgctagatgtgggctacgaaagtagtccgtgccgtaagctaacgcgttaagcatcccgcctgggaagtacggccgcaaggttgaaactcaaaggaattgacggggacccgcacaaccggtggagcgtctggtttaattcgatgctaaccgaataacctcaccagggtttgacatgcggtgtgtcgggtatgaaagtaccctaggctatgattattcatagccgcgccgcacaggtggtgcatggtcgtcgtcagctcgtgtcgtgagatgttgggttaagtcccgcaacgagcgcaacccttgtcctgtgttaccagcgggtaatgccgggtactcacaggagactgccggcgataagccggaggaaggaggggatgacgtcagatcagtatgccctttatgccctgggctacacaggcgctacagtggcagggacaatgggctgcaacgctgcaaggcggagctaatcccataaaccctgtcgtggtgcagattgagggttgcaactcaccctcatgaaggcggaatcggtagtaatggcgaatcagcaatgtcgccgtgaatacgttcccgggtcttgtacacaccgcccgtcacgccatgggagtcgggttcatcggaagtccccgggctaacctgcaaaggaggcaggggccgatgatgggcctgatgactggggcgaagtcgtaacaaggtagccctaggggaacctggggctggatcacctcctttata

SEQ ID NO: 9525 - DNA, 1529 bp, Sulfurihydrogenibium subterraneum
  ref <308>: DATABASE ACCESSION NUMBER: NCBI ACCESSION: NZ_JHUV01000009.1
  ref <309>: DATABASE ENTRY DATE: 2019-04-01
  ref <313>: RELEVANT RESIDUES IN SEQ ID NO: (1)..(1529)
ttggagagtttgatcctggctcagcgcgaacgttggcggcgtgcctaacacatgcaagtcgaggggcagcaggctactaccttcgggtagtagtgctggcgaccggcaaacgggtgagtaacacgtagctaacctacccataggttggggataaccatccgaaagggtggctaatacccaataaagaggggactccaaagcccttacgggtgcctatggatggggctgcgtcccatcagctagttggtgaggtaaaggctcaccaaggctacgacgggtaaccggtctgagaggatgatcggtcacagtgggactgagacacggcccgcacccctacggggggcagcagtggggaatattgggcaatggccgaaaggctgacccagcaacgccgcgtggtggaaggagcccttcggggtgtaaacaccttttctgggggaagacaatgacggtaccccaggaataagggacggctaactacgtgccagcagccgcggtaatacgtaggtcccgaacgttgcgcgaaattactgggcgtaaagggtccgtaggcggtctggtaagtggaaggtgaaatcctacggctcaaccgtagaattgccttccaaactgccggacttgaggcagggagaggtcggcggaattcccggtgtagcggtgaaatgcgtagatatcgggaggaacaccagtggcgaaggcggccgactggaactgacctgacgctgagggacgaaagctaggggagcaaaccggattagatacccgggtagtcctagccgtaaacgatggatgctagatgtagcctacgagagtaggctgtgccgcaagcaaacgcgttaagcatcccgcctggggagtacggccgcaaggttgaaactcaaaggaattgacggggacccgcacaaccggtggagcgtctggtttaattcgatgctaaccgaaaaacctcaccagggtttgacatgcggtgtgtcgggtatgaaagtatcctaggctatgattattcatagccgcgccgcacaggtggtgcatggtcgtcgtcagctcgtgtcgtgagatgttgggttaagtcccgcaacgagcgcaacccttgtcctgtgttaccagcgggtaaagccgggtactcacaggagactgccggcgataagtcggaggaaggaggggatgacgtcagatcagtatgccctttatgccctgggctacacaggcgctacagtggcagggacaatgggacgcgacgcagcaatgcggagcaaatcccctaaaccctgtcgtggtgcggattgggggttgcaactcacccccatgaaggcggaatcggtagtaatggcgaatcagcaatgtcgccgtgaatacgttcccgggtcttgtacacaccgcccgtcacgccatgggagttgggttcatcggaagtccccgagctaaccgcgaggaggcaggggccgatgatgggcctgatgactggggcgaagtcgtaacaaggtagccctaggggaacctggggctggatcacctcctttatagggaaa

SEQ ID NO: 9526 - DNA, 1529 bp, Sulfurihydrogenibium yellowstonense
  ref <308>: DATABASE ACCESSION NUMBER: NCBI ACCESSION: NZ_ABZS01000123.1
  ref <309>: DATABASE ENTRY DATE: 2019-04-01
  ref <313>: RELEVANT RESIDUES IN SEQ ID NO: (1)..(1529)
ttggagagtttgatcctggctcagcgcgaacgttggcggcgtgcctaacacatgcaagtcgtggggcagcaggctactaccttcgggtagtagtgctggcgaccggcaaacgggtgagtaacacgtagcttacctacccataggttggggataacatcccgaaaggggtgctaatacccaataatgaggaggctccaaagcccttatgggtgcctatggatggggctgcgtcccatcagctagttggtgaggtaatggctcaccaaggctacgacgggtaaccggtctgagaggatgaccggtcacagtgggactgagacacggcccgcacccctacggggggcagcagtggggaatattgggcaatggccgaaaggctgacccagcaacgccgcgtggtggatgaagcccttcggggtgtaaacaccttttctgggggaagataatgacggtaccccaggaataagggacggctaactacgtgccagcagccgcggtaatacgtaggtcccgaacgttgcgcgaatttactgggcgtaaagggtccgtaggcggtttagcaagtggttggtgaaatttcacggctcaaccgtgaaactgccttccaaactgctaaacttgaggcagggagaggtcggcggaattcccggtgtagcggtgaaatgcgtagatatcgggaggaacaccagtggcgaaggcggccgactggaactgtcctgacgctgagggacgaaagctaggggagcaaaccggattagatacccgggtagtcctagccgtaaacgatggatgctagatgtgggctacgaaagtagtccgtgccgtaagctaacgcgttaagcatcccgcctggggagtacggccgcaaggttgaaactcaaaggaattgacggggacccgcacaaccggtggagcgtctggtttaattcgatgctaaccgaaaaacctcaccagggtttgacatgcggtgtgtcgggtatgaaagtaccctaggctatgattattcatagccgcgccgcacaggtggtgcatggtcgtcgtcagctcgtgtcgtgagatgttgggttaagtcccgcaacgagcgcaacccttgtcctgtgttaccagcgggtaatgccgggtactcacaggagactgccggcgataagccggaggaaggaggggatgacgtcagatcagtatgccctttatgccctgggctacacaggcgctacagtggcagggacaatgggctgcaacgccgtaaggcggagctaatcccctaaaccctgtcgtggtgcagattgagggttgcaactcaccctcatgaaggcggaatcggtagtaatggcgaatcagcaatgtcgccgtgaatacgttcccgggtcttgtacacaccgcccgtcacgccatgggagtcgggttcatcggaagtccccgagctaacctgcaaaggaggcaggggccgatgatgggcctgatgactggggcgaagtcgtaacaaggtagccctaggggaacctggggctggatcacctcctttataggga

SEQ ID NO: 9527 - DNA, 1550 bp, Sulfurirhabdus autotrophica
  ref <308>: DATABASE ACCESSION NUMBER: NCBI ACCESSION: NZ_BHVT01000014.1
  ref <309>: DATABASE ENTRY DATE: 2019-04-01
  ref <313>: RELEVANT RESIDUES IN SEQ ID NO: (1)..(1550)
agattaaactgaagagtttgatcctggctcagattgaacgctggcggaatgctttacacatgcaagtcgaacggcagcacgggtgcttgcacctggtggcgagtggcgaacgggtgagtaatacgtaggaacatgtcctgtaatgggggataacgcaccgaaaggtgtgctaataccgcatacgccctgagggggaaagcgggggattcgaaagaacctcgcgttataggagtggcctacggctgattagctagttggtgaggtaaaggctcaccaaggcgacgatcagtagctggtctgagaggatgatcagccacactggaactgagacacggtccagactcctacgggaggcagcagtggggaattttggacaatgggggcaaccctgatccagccattccgcgtgagtgaagaaggccttcgggttgtaaagctctttcaggagggaagaaacggttttggctaatacctgagactaatgacggtaccttcagaagaagcaccggctaactacgtgccagcagccgcggtaatacgtagggtgcgagcgttaatcggaattactgggcgtaaagggtgcgcaggcggttttgtaagtcagatgtgaaagccccgggcttaacctgggaattgcgtttgaaactacaagactagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgtcgggagctttatgcttttggtaacgcagctaacgcgtgaagttgaccgcctggggagtacggtcgcaagattaaaactcaaaggaattgacgggggcccgcacaagcggtggattatgtggattaattcgatgcaacgcgaaaaaccttacctacccttgacatgccaggaactttccagagatggattggtgcccgaaagggagcctggacacaggtgctgcatggctgtcgtcagctcgtgtcgtgagatgttgggttaagtcccgcaacgagcgcaacccttgtcattaattgccatcattcagttgggcactttaatgagactgccggtgacaaaccggaggaaggtggggatgacgtcaagtcctcatggcccttatgggtagggcttcacacgtaatacaatggcgcgtacagagggttgccaacccgcgagggggagctaatctcacaaagcgcgtcgtagtccggattgtagtctgcaactcgactacatgaagtcggaatcgctagtaatcgcggatcagcatgtcgcggtgaatacgttcccgggccttgtacacaccgcccgtcacaccatgggagtgggtttcaccagaagtagttagcctaaccgcaaggggggcgattaccacggtgaggttcatgactggggtgaagtcgtaacaaggtagccgtaggggaacctgcggctggatcacctcctttctag

SEQ ID NO: 9528 - DNA, 1546 bp, Sulfurisoma sediminicola
  ref <308>: DATABASE ACCESSION NUMBER: NCBI ACCESSION: NZ_BHVV01000003.1
  ref <309>: DATABASE ENTRY DATE: 2019-04-01
  ref <313>: RELEVANT RESIDUES IN SEQ ID NO: (1)..(1546)
agattgaactgaagagtttgatcctggctcagattgaacgctggcggaatgctttacacatgcaagtcgagcggcagcgcgggggcaaccctggcggcgagcggcgaacgggtgagtaatgcatcggaacgtacccatttgtgggggataactatccgaaaggatagctaataccgcataagtcctgagggagaaagcaggggatcgcaagaccttgcgcgaatggagcggccgatgccggattagctagttggtagggtaaaggcctaccaaggcgacgatccgtagctggtctgagaggatgatcagccacactggaactgagacacggtccagactcctacgggaggcagcagtggggaattttggacaatgggggcaaccctgatccagccattccgcgtgagtgaagaaggccttcgggttgtaaagctctttcggcaggaacgaaacggtttgggttaataccctgagctaatgacggtacctgaagaagaagcaccggctaactacgtgccagcagccgcggtaatacgtagggtgcgagcgttaatcggaattactgggcgtaaagcgtgcgcaggcggttctataagacagatgtgaaatccccgggcttaacctgggaactgcgtttgtgactgtaggactcgagtgtggcagaggggggtggaattccacgtgtagcagtgaaatgcgtagagatgtggaggaacaccgatggcgaaggcagccccctgggtcaacactgacgctcatgcacgaaagcgtgggtagcaaacaggattagataccctggtagtccacgccctaaacgatgcgaactaggtgttggggaaggagactttcttagtaccgcagctaacgcgtgaagttcgccgcctggggagtacggtcgcaagattaaaactcaaaggaattgacggggacccgcacaagcggtggatgatgtggattaattcgatgcaacgcgaaaaaccttacctacccttgacatgccaggaacttggtagagataccttggtgcccgaaagggagcctggacacaggtgctgcatggctgtcgtcagctcgtgtcgtgagatgttgggttaagtcccgcaacgagcgcaacccttgtcattagttgccatcatttagttgggcactctaatgagactgccggtgacaaaccggaggaaggtggggatgacgtcaagtcctcatggcccttatgggtagggcttcacacgtcatacaatggtcggtacagagggttgccaagccgcgaggtggagccaatcccagaaagccgatcgtagtccggatcggagtctgcaactcgactccgtgaagtcggaatcgctagtaatcgtggatcagcatgccacggtgaatacgttcccgggtcttgtacacaccgcccgtcacaccatgggagtgggtttcaccagaagtaggtagcctaaccgcaaggggggcgcttaccacggtgggattcatgactggggtgaagtcgtaacaaggtagccgtaggggaacctgcggctggatcacctcctttcta

SEQ ID NO: 9529 - DNA, 1541 bp, Sulfuritortus calidifontis
  ref <308>: DATABASE ACCESSION NUMBER: NCBI ACCESSION: NZ_AP018721.1
  ref <309>: DATABASE ENTRY DATE: 2019-04-01
  ref <313>: RELEVANT RESIDUES IN SEQ ID NO: (1)..(1541)
agattgaactgaagagtttgatcctggctcagattgaacgctggcggcatgccttacacatgcaagtcgaacggcagcacgggagcttgctcctggtggcgagtggcgaacgggtgagtaaagcatcggaacgtaccgcgtagtgggggataacgtagcgaaagttacgctaataccgcatacgtcctgagggagaaagcgggggtcgcaagacctcgcgctatgcgagcggccgatgtcggattagctagttggtggggtaagagcctaccaaggcgacgatccgtagcgggtctgagaggatgatccgccacactgggactgagacacggcccagactcctacgggaggcagcagtggggaattttggacaatgggggaaaccctgatccagccatgccgcgtgggtgaagaaggccttcgggttgtaaagccctttcggacggaaagaaatcatcgcctctaacataggcggtggatgacggtaccgtaagaagaagcaccggctaactacgtgccagcagccgcggtaatacgtagggtgcgagcgttaatcggaattactgggcgtaaagcgtgcgcaggcggttttttaagccagatgtgaaatccccgggcttaacctgggaatggcatttggaactggaagactagagtgcggcagaggggggtggaattcctggtgtagcagtgaaatgcgtagagatcaggaggaacaccgatggcgaaggcagccccctgggccgacactgacgctcatgcacgaaagcgtggggagcaaacaggattagataccctggtagtccacgccctaaacgatgtcaactggctgttgggggagcaatctcttagtagcgaagctaacgcgtgaagttgaccgcctggggagtacggccgcaaggttgaaactcaaaggaattgacgggggcccgcacaagcggtggatgatgtggattaattcgatgcaacgcgaagaaccttacctacccttgacatggcaggaacttgccagagatggcttggtgcccgaaagggaacctgcacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttatgggtagggcttcacacgtcatacaatggtcggtacagagggttgccaacccgcgagggggagccaatcccagaaaaccgatcgtagtccggattgttctctgcaactcgagagcatgaagtcggaatcgctagtaatcgcggatcagcatgccgcggtgaatacgttcccgggccttgtacacaccgcccgtcacaccatgggagtgggttgctccagaagtaggtagcctaaccgcgaggggggcgcttaccacggagtgattcatgactggggtgaagtcgtaacaaggtagccgtaggggaacctgcggctggatcacctcctttctag

SEQ ID NO: 9530 - DNA, 1542 bp, Sulfurivermis fontis
  ref <308>: DATABASE ACCESSION NUMBER: NCBI ACCESSION: NZ_AP018724.1
  ref <309>: DATABASE ENTRY DATE: 2019-04-01
  ref <313>: RELEVANT RESIDUES IN SEQ ID NO: (1)..(1542)
taaactgaagagtttgatcctggctcagattgaacgctagcggcatgcttaacacatgcaagtcgaacggcagcacgggcttcggcctggtggcgagtggcggacgggtgagtaatgcataggaatctgcctggcaatgggggacaacttggggaaactcaagctaataccgcatacgccctacgggggaaagcgggggatcttcggacctcgcgttgtcagatgagcctatgtccgattagctagttggtggggtaaaggcctaccaaggcgacgatcggtagctggtctgagaggacgaccagccacactgggactgagacacggcccagactcctacgggaggcagcagtggggaatattggacaatgggggcaaccctgatccagcaatgccgcgtgggtgaagaaggcctgcgggttgtaaagccctttcagtagggaggaaaagctgaaagccaatacctttcagtgttgacgttacctacagaagaagcaccggctaactctgtgccagcagccgcggtaatacagagggtgcaagcgttaatcggaattactgggcgtaaagcgcacgtaggtggtttgataagtcgggtgtgaaatccctgggctcaacctaggaattgcattcgatactgtctgactagagtatggtagaggggggtagaattcccggtgtagcggtgaaatgcgtagatatcgggaggaataccagtggcgaaggcggccccctggaccaatactgacactgaggtgcgaaagcgtgggtagcaaacaggattagataccctggtagtccacgccgtaaacgatgtcaactagacgttggggagattaaactccttagtgtcgcagctaacgcgataagttgaccgcctggggagtacggccgcaaggttaaaactcaaaggaattgacgggggcccgcacaagcggtggagtatgtggtttaattcgatgcaacgcgaaaaaccttacctgcccttgacatcctcggaacttgtcagagatgacttggtgccttcgggaaccgagagacaggtgctgcatggctgtcgtcagctcgtgtcgtgagatgttgggttaagtcccgtaacgagcgcaacccttgtccctagttgccagcacgtaatggtgggaactctagggagactgccggtgacaaaccggaggaaggtggggatgacgtcaagtcatcatggcccttatgggcagggctacacacgtactacaatggtcggtacagagggctgccaacccgcgagggggagccaatcccagaaaaccggtcgtagtccggattggagtctgcaactcgactccatgaagtcggaatcgctagtaatcgcagatcagcatgctgcggtgaatacgttcccgggccttgtacacaccgcccgtcacaccatgggagttggttgtaccagaagtcggtagtctaaccgcaaggaggacgccgcccacggtatggtcaatgactggggtgaagtcgtaacaaggtagccgtaggggaacctgcggctggatcacctcctttcaa

SEQ ID NO: 9531 - DNA, 1513 bp, Sulfurospirillum sp. JPD-1
  ref <308>: DATABASE ACCESSION NUMBER: NCBI ACCESSION: NZ_CP023275.1
  ref <309>: DATABASE ENTRY DATE: 2019-04-01
  ref <313>: RELEVANT RESIDUES IN SEQ ID NO: (1)..(1513)
ttttatggagagtttgatcctggctcagagtgaacgctggcggcgtgcttaacacatgcaagtcgaacggatgaaataagcttgcttatttcgttagtggcgcacgggtgagtaatgtatagctaacctgccctttagtgggggacaacagttggaaacggctgctaataccccatactccttcttatcataaggtaagttgggaaagatttattgctaaaggatggggctttatggtatcagttagttggtggggtaatggcctaccaagactatgacgcctacctggtctgagaggatgatcaggcacactggaactgagacacggtccagactcctacgggaggcagcagtggggaatattgcacaatggaggaaactctgatgcagcaacgccgcgtggaggatgacgcatttcggtgtgtaaactccttttataagggaagataatgacggtaccttatgaataagcaccggctaactccgtgccagcagccgcggtaatacggagggtgcaagcgttactcggaatcactgggcgtaaaggatgcgtaggctggaaatcaagtcgagagtgaaatccaacggcttaaccgttgaactgctctcgaaactggttacctagaatatgggagaggtagatggaattggtggtgtaggggtaaaatccgtagatatcaccaggaataccgattgcgaaggcgatctactggaacattattgacgctgaggcatgaaagcgtggggagcaaacaggattagataccctggtagtccacgccctaaacgatgcacactagttgttgcgatgctagtcattgcagtaatgcacttaacagattaagtgtgccgcctggggagtacggtcgcaagattaaaactcaaaggaatagacggggacccgcacaagcggtggagcatgtggtttaattcgaagatacacgaagaaccttacctggccttgatatcctaagaatcctgtagagatacgggagtgctagtttactagaacttagagacaggtgctgcacggctgtcgtcagctcgtgtcgtgagatgttgggttaagtcccgcaacgagcgcaaccctcgtgattagttgctaacagttcggctgagcactctaatcagactgccttcgtaaggaggaggaaggtgaggacgacgtcaagtcatcatggcccttatggccagggctacacacgtgctacaatggctaggacaaagagacgcgatactgcgaagtggagcaaatcttaaaacctagtctcagttcggattggagtctgcaactcgactccatgaagctggaatcgctagtaatcgtagatcagatatgctacggtgaatacgttcccgggtcttgtactcaccgcccgtcacaccatgggagttgaattcacccgaagccggaatactaaactagttaccgaccacggtgggttcagcgactggggtgaagtcgtaacaaggtaaccgtaggagaacctgcggttggatcacctcctttcta

SEQ ID NO: 9532 - DNA, 1512 bp, Sulfurospirillum sp. SL2-1
  ref <308>: DATABASE ACCESSION NUMBER: NCBI ACCESSION: NZ_CP021416.1
  ref <309>: DATABASE ENTRY DATE: 2019-04-01
  ref <313>: RELEVANT RESIDUES IN SEQ ID NO: (1)..(1512)
tttatggagagtttgatcctggctcagagtgaacgctggcggcgtgcttaacacatgcaagtcgaacggatgaaataagcttgcttatttcgttagtggcgcacgggtgagtaatgtatagctaacctgccctttagtgggggacaacagttggaaacggctgctaataccccatactccttcttatcataaggtaagttgggaaagatttattgctaaaggatggggctttattgtatcagctagttggtggggtaatggcctaccaaggctatgacgcatacctggtctgagaggatgatcaggcacactggaactgagacacggtccagactcctacgggaggcagcagtggggaatattgcacaatggaggaaactctgatgcagcaacgccgcgtggaggatgacgcatttcggtgtgtaaactccttttataagggaagataatgacggtaccttatgaataagcaccggctaactccgtgccagcagccgcggtaatacggagggtgcaagcgttactcggaatcactgggcgtaaaggatgcgtaggctggaaatcaagtcgagagtgaaatccaacggcttaaccgttgaactgctctcgaaactggttacctagaatatgggagaggtagatggaattggtggtgtaggggtaaaatccgtagatatcaccaggaataccgattgcgaaggcgatctactggaacattattgacgctgaggcatgaaagcgtggggagcaaacaggattagataccctggtagtccacgccctaaacgatgcacactagttgttgcgatgctagtcattgcagtaatgcacttaacagattaagtgtgccgcctggggagtacggtcgcaagattaaaactcaaaggaatagacggggacccgcacaagcggtggagcatgtggtttaattcgaagatacacgaagaaccttacctggccttgatatcctaagaatcctgtagagatacgggagtgctagtttactagaacttagagacaggtgctgcacggctgtcgtcagctcgtgtcgtgagatgttgggttaagtcccgcaacgagcgcaaccctcgtgattagttgctaacagttcggctgagcactctaatcagactgccttcgtaaggaggaggaaggtgaggacgacgtcaagtcatcatggcccttatggccagggctacacacgtgctacaatggctaggacaaagagacgcgatactgcgaagtggagcaaatcttaaaacctagtctcagttcggattggagtctgcaactcgactccatgaagctggaatcgctagtaatcgtagatcagatatgctacggtgaatacgttcccgggtcttgtactcaccgcccgtcacaccatgggagttgaattcacccgaagccggaatactaaactagttaccgaccacggtgggttcagcgactggggtgaagtcgtaacaaggtaaccgtaggagaacctgcggttggatcacctcctttcta

SEQ ID NO: 9533 - DNA, 1512 bp, Sulfurospirillum sp. SL2-2; identical to SEQ ID NO: 9532
  ref <308>: DATABASE ACCESSION NUMBER: NCBI ACCESSION: NZ_CP021979.1
  ref <309>: DATABASE ENTRY DATE: 2019-04-01
  ref <313>: RELEVANT RESIDUES IN SEQ ID NO: (1)..(1512)

SEQ ID NO: 9534 - DNA, 1552 bp, Superficieibacter electus
  ref <308>: DATABASE ACCESSION NUMBER: NCBI ACCESSION: NZ_PQGD01000069.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaagcagcttgctgctttgctgacgagtggcggacgggtgagtaatgtctgggaaactgcctgatggagggggataactactggaaacggtagctaataccgcataacgtcttcggaccaaagagggggaccttcgggcctcttgccatcggatgtgcccagatgggattagctagttggtggggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagaatggttaataaccattttcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacccgggaactgcattcgaaactggcagactggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtctatttggaggctgtgcccttgaggcgtggcttccggagctaacgcgttaaatagaccgcctggggagtacggccgcaaggttaaaactcaaatgaattgacgggggcccgcacaagcggtggagcatgtggtttaattcgatgcaacgcgaagaaccttacctggtcttgacatccacagaacttggcagagatgccttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 9535 - DNA, 1540 bp, Sutterella megalosphaeroides
  ref <308>: DATABASE ACCESSION NUMBER: NCBI ACCESSION: NZ_AP018786.1
  ref <309>: DATABASE ENTRY DATE: 2019-04-01
  ref <313>: RELEVANT RESIDUES IN SEQ ID NO: (1)..(1540)
agattgaactgaagagtttgatcctggctcagattgaacgctggcggcatgctttacacatgcaagtcgaacggcagcacggggagcttgctcccgggtggcgagtggcgcacgggtgagtaatacatcggaacgtgtcctcttgtgggggataacaacccgaaagggttgctaataccgcatgagacctgagggtgaaagcgggggatcgcaagacctcgcgcaaggggagcggccgatgcccgattagctggttggtgaggtaaaggctcaccaaggcgacgatcggtagctggtctgagaggacgaccagccacactgggactgagacacggcccagactcctacgggaggcagcagtggggaattttggacaatgggggaaaccctgatccagccatgccgcgtgcaggatgaaggtcttcggattgtaaactgcttttgtcagggacgaaaaggtttcggttaatacccggaactgctgacggtacctgaagaataagcaccggctaactacgtgccagcagccgcggtaatacgtagggtgcaagcgttaatcggaattactgggcgtaaagcgtgcgcaggcggttccgtaagatagatgtgaaatccccgggcttaacctgggaattgcatttatgactgcgggactggagtttatcagaggggggtggaattccaagtgtagcagtgaaatgcgtagatatttggaagaacaccaatggcgaaggcagccccctgggatacgactgacgctcatgcacgaaagcgtggggagcaaacaggattagataccctggtagtccacgccctaaacgatgtctactggttgttggggattcatttccttggtaacgaagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgccaggaatcccgaagagatttgggagtgcccgcaagggaatctggacacaggtgctgcatggctgtcgtcagctcgtgtcgtgagatgttgggttaagtcccgcaacgagcgcaacccttgtcactagttgctacgaaagggcactctagtgagactgccggtgacaaaccggaggaaggtggggatgacgtcaagtcctcatggcccttatggctagggcctcacacgtcatacaatggtcggaacagagggcagcgaagccgcgaggcggagcaaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtggggttcaccagaagacgtttgtttaaccgcaaggaggacggcgtccacggtgggcttcatgactggggtgaagtcgtaacaaggtagccgtaccggaaggtgcggctggatcacctccttt

SEQ ID NO: 9536 - DNA, 1537 bp, Sutterella sp. AF15-44LB
  ref <308>: DATABASE ACCESSION NUMBER: NCBI ACCESSION: NZ_QRYK01000004.1
  ref <309>: DATABASE ENTRY DATE: 2019-04-01
  ref <313>: RELEVANT RESIDUES IN SEQ ID NO: (1)..(1537)
gattgaactcaagagtttgatcctggctcagattgaacgctggcggcatgccttacacatgcaagtcgaacggcagcgggggagcttgctcctgccggcgagtggcgaacgggtgagtaatgcatcggaacgtgtcctgttgtgggggataactgatcgaaagatcagctaataccgcatgagacctgagggtgaaagcgggggatcgcaagacctcgcgcgacaggagcggccgatgtctgattagctagttggtgagataaaagcttaccaaggcgacgatcagtagctggtctgagaggatgatcagccacattgggactgagacacggcccagactcctacgggaggcagcagtggggaattttggacaatgggggaaaccctgatccagccatgccgcgtgcgggatgaaggccttcgggttgtaaaccgcttttgtcagagacgaaaagggacgcacgaataatacgttccgctgacggtatctgaagaataagcaccggctaactacgtgccagcagccgcggtaatacgtagggtgcaagcgttaatcggaattactgggcgtaaagggtgcgcaggcggctgtgcaagacagatgtgaaatccccgggcttaacctgggaactgcatttgtgactgcacggctagagtttgtcagaggagggtggaattccgcgtgtagcagtgaaatgcgtagatatgcggaagaacaccaatggcgaaggcagccctctgggacatgactgacgctcatgcacgaaagcgtggggagcaaacaggattagataccctggtagtccacgccctaaacgatgtcagctgattgttcgggaagcaattcctgggtaaccaagccaacgcgtgaagctgaccgcctgggaagtacggtcgcaagattaaaactcaaaggaattgacggggacccgcacaagcggtggatgatgtggattaattcgacgcaacgcgaaaaaccttacctagccttgacatgtcaggaatccggatgaaagtctggagtgcccgcaagggagcctgaacacaggtgctgcatggctgtcgtcagctcgtgtcgtgagatgttgggttaagtcccgcaacgagcgcaacccttgtcatcagttgctacgcaagagcactctgatgagaccgccggtgacaaaccggaggaagatggggatgacgtcaagtcctcatggcccttacggctagggcctcacacgtcatacaatggtcggaacagagggcagcgaagccgggaggcggagctaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtggggtttgccagaaggcgtttgtccaaccgcaaggaggacggcgaccacggtgggttccatgactggggtgaagtcgtaacaaggtagcagtaccggaaggtgcggctggatcacctccttt

SEQ ID NO: 9537 - DNA, 1537 bp, Sutterella sp. AF15-45LB; identical to SEQ ID NO: 9536
  ref <308>: DATABASE ACCESSION NUMBER: NCBI ACCESSION: NZ_QRYJ01000004.1
  ref <309>: DATABASE ENTRY DATE: 2019-04-01
  ref <313>: RELEVANT RESIDUES IN SEQ ID NO: (1)..(1537)

SEQ ID NO: 9538 - DNA, 1542 bp, Sutterella sp. AM11-39
  ref <308>: DATABASE ACCESSION NUMBER: NCBI ACCESSION: NZ_QRLV01000022.1
  ref <309>: DATABASE ENTRY DATE: 2019-04-01
  ref <313>: RELEVANT RESIDUES IN SEQ ID NO: (1)..(1542)
agattgaactgaagagtttgatcctggctcagattgaacgctggcggcatgctttacacatgcaagtcgaacggcagcatagagagcttgctctctgatggcgagtggcgaacgggtgagtaatacatcggaacgtgtccgtttgtgggggacaaccacccgaaagggtggctaataccgcataagacctgagggtgaaagccggggaccgcaaggcctggcgcgaacggagcggccgatgactgattagctggttggcggggtaaaggcccaccaaggcgacgatcagtagctggtctgagaggacgaccagccacactggaactgagacacggtccagactcctacgggaggcagcagtggggaattttggacaatgggggcaaccctgatccagccatgccgcgtgcgggaagaaggccttcgggttgtaaaccgcttttgtcagggacgaaaaggtgcgggttaagagctagcactgatgacggtacctgaagaataagcaccggctaactacgtgccagcagccgcggtaatacgtagggtgcgagcgttaatcggaattactgggcgtaaagcgtgcgcaggcggttgggtaagacagatgtgaaatccccgggcttaacctgggaactgcatttgtgactgtccgactggagtatgtcagaggggggtggaattccaagtgtagcagtgaaatgcgtagatatttggaagaacaccgatggcgaaggcagccccctggggcaaaactgacgctcatgcacgaaagcgtggggagcaaacaggattagataccctggtagtccacgccctaaacgatgtctactggttgttggagggtaaaaccttcagtaacgaagctaacgcgtgaagtagaccgcctggggagtacggtcgcaagattaaaactcaaaggaattgacggggacccgcacaagcggtggatgatgtggattaattcgatgcaacgcgaaaaaccttacctagccttgacatgtcaggaacgctccggagatggggcggtgcccgcaagggaacctgagcacaggtgctgcatggctgtcgtcagctcgtgtcgtgagatgttgggttaagtcccgcaacgagcgcaacccttgtcactagttgctacgtaacagagcactctagtgagactgccggtgacaaaccggaggaaggtggggatgatgtcaagtcctcatggcccttatggctagggcctcacacgtcatacaatggtcggaacagagggcagcgaaaccgcgaggtggagcaaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtggggttcaccagaagacgtttgcctaaccgcaaggagggcggcggccacggtgggtttcatgactggggtgaagtcgtaacaaggtagccgtaccggaaggtgcggctggatcacctccttt

SEQ ID NO: 9539 - DNA, 1537 bp, Sutterella sp. AM18-8-1; identical to SEQ ID NO: 9536
  ref <308>: DATABASE ACCESSION NUMBER: NCBI ACCESSION: NZ_QRJD01000017.1
  ref <309>: DATABASE ENTRY DATE: 2019-04-01
  ref <313>: RELEVANT RESIDUES IN SEQ ID NO: (1)..(1537)

SEQ ID NO: 9540 - DNA, 1537 bp, Sutterella sp. KCTC 15688
  ref <308>: DATABASE ACCESSION NUMBER: NCBI ACCESSION: NZ_BHWA01000009.1
  ref <309>: DATABASE ENTRY DATE: 2019-04-01
  ref <313>: RELEVANT RESIDUES IN SEQ ID NO: (1)..(1537)
gattgaactcaagagtttgatcctggctcagattgaacgctggcggcatgccttacacatgcaagtcgaacggcagcgggggagcttgctcctgccggcgagtggcgaacgggtgagtaatgcatcggaacgtgtcctgttgtgggggataactgatcgaaagatcagctaataccgcatgagacctgagggtgaaagcgggggatcgcaagacctcgcgcgacaggagcggccgatgtctgattagctagttggtgagataaaagcttaccaaggcgacgatcagtagctggtctgagaggatgatcagccacattgggactgagacacggcccagactcctacgggaggcagcagtggggaattttggacaatgggggaaaccctgatccagccatgccgcgtgcgggatgaaggccttcgggttgtaaaccgcttttgtcagagacgaaaagggacgtacgaataatacgttccgctgacggtatctgaagaataagcaccggctaactacgtgccagcagccgcggtaatacgtagggtgcaagcgttaatcggaattactgggcgtaaagggtgcgcaggcggctatgcaagacagatgtgaaatccccgggcttaacctgggaactgcatttgtgactgcatggctagagtttgtcagaggagggtggaattccgcgtgtagcagtgaaatgcgtagatatgcggaagaacaccaatggcgaaggcagccctctgggacatgactgacgctcatgcacgaaagcgtggggagcaaacaggattagataccctggtagtccacgccctaaacgatgtcagctgattgttcgggaagcaattcctgggtaaccaagccaacgcgtgaagctgaccgcctgggaagtacggtcgcaagattaaaactcaaaggaattgacggggacccgcacaagcggtggatgatgtggattaattcgacgcaacgcgaaaaaccttacctagccttgacatgtcaggaatccggatgaaagtctggagtgcccgcaagggagcctgaacacaggtgctgcatggctgtcgtcagctcgtgtcgtgagatgttgggttaagtcccgcaacgagcgcaacccttgtcatcagttgctacgcaagagcactctgatgagaccgccggtgacaaaccggaggaagatggggatgacgtcaagtcctcatggcccttacggctagggcctcacacgtcatacaatggtcggaacagagggcagcgaagccgggaggcggagctaatcccagaaaaccgatcgtagtccggattgcagtctgcaactcgactgcatgaagtcggaatcgctagtaatcgcggatcagcatgccgcggtgaatacgttcccgggtcttgtacacaccgcccgtcacaccatgggagtggggtttgccagaaggcgtttgtccaaccgcaaggaggacggcgaccacggtgggttccatgactggggtgaagtcgtaacaaggtagcagtaccggaaggtgcggctggatcacctccttt

SEQ ID NO: 9541 - DNA, 1576 bp, Symbiobacterium thermophilum
  ref <308>: DATABASE ACCESSION NUMBER: NCBI ACCESSION: NC_006177.1
  ref <309>: DATABASE ENTRY DATE: 2019-04-01
  ref <313>: RELEVANT RESIDUES IN SEQ ID NO: (1)..(1576)
tttccacggagagtttgatcctggctcaggacgaacgctggcggcgtgcctaagacatgcaagtcgagcggggtttcagggcttcggccctgagacccagcggcggacgggtgagtaacacgtggataacctgccctctgctctgggataacaggccgaaaggcctgctaataccggataagctcacggacccgcatgggtttgggagaaaaggcgctggagtcagtggcgctggcagaggaggggtccgcggcccattagctggttggcggggtaacggcccaccaaggcgacgatgggtagccggcctgagagggcgaccggccacactgggactgagacacggcccagactcctacgggaggcagcagtcgggaattttgcacaatggccgaaaggctgatgcagcaacgccgcgtgagcgaagaaggccttcgggttgtaaagctctgttgcctgcgaagaagggccctgtcaggaaatgggcggggtttgacggtagcaggcgaggaagccccggcaaactacgtgccagcagccgcggtaatacgtagggggcgagcgttgtccggaattactgggcgtaaagggcgtgtaggcggcctgttaagtcaggggtgaaagaccggggctcaaccccgggggtgcctctgaaactggcgggcttgagtgctctagagggcagtggaattcccggtgtagcagtgaaatgcgtagagatcgggaggaacaccagtggcgaaggcggctgcctggggagtcactgacgctgaggcgcgaaagctaggggagcaaacaggattagataccctggtagtcctagtcgtaaacgatgagcgctatgtgtgaggggtatcgacccccctcgttcagtagctaacgcattaagcgctccgcctggggagtacggccgcaaggttgaaactcaaaggaattgacgggggcccgcacaagcagcggagcatgtggtttaattcgaagcaacgcgtagaaccttaccagggcttgacatccaccgaatcctgcagagatgcgggagtgcctctctaatgagaggaacggtgagacaggtggtgcatggttgtcgtcagctcgtgtcgtgagatgttgggttaagtcccgcaacgagcgcaacccctgtcgcatgttgccagcgggtaaagccgggcactcatgcgagactgccggtgacaaaccggaggaaggtggggatgacgtcaaatcatcatgccccttatgtcctgggctacacacgtgctacaatggccgtcacagagcgagccgaacctgcgagggggagggaatcgcaaaaggcggtctcagttcggatcgcaggctgcaactcgcctgcgtgaagtcggagttgctagtaatcgcggatcagcatgccgcggtgaatacgttcccgggccttgtacacaccgcccgtcacaccatgggagctggcaacacccgaagtcggtgagctaacccgcaagggaggcagccgccgaaggtggggccggtgactggggtgaagtcgtaacaaggtagccgtatcggaaggtgcggctggatcacctcctttctaaggaga

SEQ ID NO: 9542 - DNA, 1490 bp, Synechococcus elongatus
  ref <308>: DATABASE ACCESSION NUMBER: NCBI ACCESSION: NZ_CP033061.1
  ref <309>: DATABASE ENTRY DATE: 2019-04-01
  ref <313>: RELEVANT RESIDUES IN SEQ ID NO: (1)..(1490)
aaaatggagagtttgatcctggctcaggatgaacgctggcggcgtgcttaacacatgcaagtcgaacgggctcttcggagctagtggcggacgggtgagtaacgcgtgagaatctgcctacaggacggggacaacagttggaaacgactgctaatacccgatgtgccgagaggtgaaacatttatggcctgtagatgagctcgcgtctgattagctagttggtggggtaagggcctaccaaggcgacgatcagtagctggtctgagaggatgatcagccacactgggactgagacacggcccagactcctacgggaggcagcagtggggaattttccgcaatgggcgcaagcctgacggagcaacgccgcgtgggggaggaaggtttttggactgtaaaccccttttctcagggaagaagaaagtgacggtacctgaggaataagcctcggctaattccgtgccagcagccgcggtaatacgggagaggcaagcgttatccggaattattgggcgtaaagcgtccgcaggcggttaatcaagtctgttgtcaaagcgtggggctcaacctcatacaggcaatggaaactgattgactagagtatggtaggggtagcgggaattccaggtgtagcggtgaaatgcgtagatatctggaagaacaccagcggcgaaagcgcgctactgggccataactgacgctcatggacgaaagctaggggagcgaaagggattagatacccctgtagtcctagccgtaaacgatgaacactaggtgttgcgtgaatcgacccgcgcagtgccgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcccccgaatctcttggaaacgagagagtgccttcgggagcggggagacaggtggtgcatggctgtcgtcagctcgtgtcgtgagatgttgggttaagtcccgcaacgagcgcaacccacgtttttagttgccatcattcagttgggcactctagagaaactgccggtgacaaaccggaggaaggtgtggacgacgtcaagtcatcatgccccttacatcctgggctacacacgtactacaatgctccggacagcgagacgcgaagccgcgaggtgaagcaaatctcccaaaccggggctcagttcagattgcaggctgcaactcgcctgcatgaaggcggaatcgctagtaatcgcaggtcagcatactgcggtgaatacgttcccgggccttgtacacaccgcccgtcacaccatggaagttggccatgcccgaagtcgttaccctaaccgttcgcggaggggggcgccgaaggtagggctgatgactggggtgaagtcgtaacaaggtagccgtaccggaaggtgtggctggatcacctcctttc

SEQ ID NO: 9543 - DNA, 1486 bp, Synechococcus lacustris
  ref <308>: DATABASE ACCESSION NUMBER: NCBI ACCESSION: NZ_PXVC01000002.1
  ref <309>: DATABASE ENTRY DATE: 2019-04-01
  ref <313>: RELEVANT RESIDUES IN SEQ ID NO: (1)..(1486)
acaacggagagtttgatcctggctcaggatgaacgctggcggcgtgcttaacacatgcaagtcgaacgaaccttcgggttagtggcggacgggtgagtaacgcgtgagaatctgccctcaggagggggataacggctggaaacggccgctaataccccatatgccgagaggtgaaatgaatttcgcctgaggatgagctcgcgtctgattagctagttggtagggtaaaggcctaccaaggcattgatcagtagctggtctgagaggatgatcagccacactgggactgagacacggcccagactcctacgggaggcagcagtggggaatyttccgcaatgggcgcaagcctgacggagcaacgccgcgtgagggatgaaggcctctgggctgtaaacctcttttatcaaggaagaagatctgacggtacttgatgaataagccacggctaattccgtgccagcagccgcggtaatacgggagtggcaagcgttatccggaattattgggcgtaaagcgtccgcaggcggttttacaagtctgtcgttaaagcgtggagctcaactccatttcagcgatggaaactgtaagactcgagtgtggtaggggcagagggaattcccggtgtagcggtgaaatgcgtagatatcgggaagaacaccagtggcgaaagcgctctgctgggccataactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggcttgacatcctgcgaacctctgggaaaccggagggtgccttcgggagcgcagagacaggtggtgcatggctgtcgtcagctcgtgtcgtgagatgttgggttaagtcccgcaacgagcgcaacccacgtctttagttgccagcatttagttgggcactctagagagaccgccggtgacaaaccggaggaaggtgtggatgacgtcaagtcatcatgccccttacgtcctgggctacacacgtactacaatgctacggacaaagggcagcaaactcgcgagagctagcaaatcccataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccatgcccgaagtcgttacttcaacccgcaagggaggaggatgccgaaggtggggctgatgactggggtgaagtcgtaacaaggtagccgtaccggaaggtgcggctggatcacctcctaa

SEQ ID NO: 9544 - DNA, 1492 bp, Synechococcus lividus
  ref <308>: DATABASE ACCESSION NUMBER: NCBI ACCESSION: NZ_CP018092.1
  ref <309>: DATABASE ENTRY DATE: 2019-04-01
  ref <313>: RELEVANT RESIDUES IN SEQ ID NO: (1)..(1492)
caacatggagagtttgatcctggctcaggatgaacgctggcggtctgcttaacacatgcaagtcgaacgagctcttcggagctagtggcggacgggtgagtaacacgtgagaatctacccttaggagggggataacagctggaaacggctgctaataccccatatgccgcaaggtgaaatcttttttggcctgaggatgagctcgcggtggattagctagttggtggggtaatggcctaccaaggcaacgatccatagctggtctgagaggatgatcagccacactgggactgagacacggcccagactcctacgggaggcagcagtggggaattttccgcaatgggcgaaagcctgacggagcaagaccgcgtgagggatgaaggcctttgggttgtaaacctcttttctcagggaagaacacaatgacggtacctgaggaataagcctcggctaactccgtgccagcagccgcggtaagacggaggaggcaagcgttatccggaattattgggcgtaaagcgtccgcaggtggctttccaagtctgctgtcaaagcccgaggcttaacctcggatcggcggtggaaactggatcgctagagtacgtcaggggtagggggaattcccggtgtagcggtgaaatgcgtagatatcgggaagaacaccagcgacgaaagtgccctactgggacgttactgacactcatggacgaaagctaggggagcgaaagggattagatacccctgtagtcctagccgtaaacgatggacactaggtgttgctggtatccactccagcagtgccgtagccaacgcgttaagtgtcccgcctggggagtacgcacgcaagtgtgaaactcaaaggaattgacgggggcccgcacaagcggtggagtatgtggtttaattcgatgcaacgcgaagaaccttaccagggcttgacatgtcgcgaatccccctgaaaggggggagtgccttcgggaacgcgaacacaggtggtgcatggctgtcgtcagctcgtgtcgtgagatgttgggttaagtcccgcaacgagcgcaaccctcgtccttagttgccagcattcagttgggcactctagggagactgccggtgacaaaccggaggaaggtggggatgacgtcaagtcatcatgccccttacgccctgggctacacacgtactacaatgctgtggacagagagttgccaacccgcgagggcgagctaatctcttaaaccacggctcagttcagattgcaggctgcaactcgcctgcatgaaggcggaatcgctagtaatcgcaggtcagcatactgcggtgaatacgttcccgggccttgtacacaccgcccgtcacaccatgggagttggccacgcccgaagtcgttactctaacccgtaagggagggggacgcctaaggcagggctgatgactggggtgaagtcgtaacaaggtagccgtaccggaaggtgtggctggatcacctcctttt

SEQ ID NO: 9545 - DNA, 1472 bp, Synechococcus sp. 60AY4M2
  ref <308>: DATABASE ACCESSION NUMBER: NCBI ACCESSION: NZ_AUMZ01000001.1
  ref <309>: DATABASE ENTRY DATE: 2019-04-01
  ref <313>: RELEVANT RESIDUES IN SEQ ID NO: (1)..(1472)
acgaagagtttgatcctggctcaggatgaacgctggcggtatgcctaacacatgcaagtcggacggacaccttcgggtgtcagtggcggacgggtgagtaacgcgtaggaatctacccctaggagggggataacagctggaaacggctgctaataccccatacaggcgcgagctgaaaggagcaatccgcctagggatgagcctgcgtcggattagctagttggtggggtaatggcctaccaaggcgacgatccgtagcgggtctgagaggatggcccgccacactgggactgagacacggcccagactcctacgggaggcagcagtggggaattttccgcaatgggcgaaagcctgacggagcaataccgcgtgagggaggaaggccttcgggttgtaaacctcttttctgggggacgaaggggtgacggtaccccaggaataagcctcggctaactctgtgccagcagccgcggtaagacagaggaggcgagcgttatccggagttattgggcgtaaagggtacgtaggcggctggtcaagtctggggttaaagaccacagcttaactgtgggggggccttggaaactgaccggctggagtggggcaggggttgcgggaattcccggtgtagcggtgaaatgcgtagatatcgggaagaacacctgaggcgaaagcgcgcaactgggccctaactgacgctgaggtacgaaagctaggggagcgaatgggattagataccccagtagtcctagccgtaaacgatggacactagacgttggccgtatcgacccggtcagtgtcgtagctaacgcgttaagtgtcccgcctggggagtacgcacgcaagtgtgaaactcaaaggaattgacgggggcccgcacaagcggtggagcatgtggtttaattcgatgcaaagcgaagaaccttaccagggcttgacatgccgcgaaccctgcggaaacgtgggagtgccttcgggagcgcggacacaggtggtgcatggctgtcgtcagctcgtgtcgtgagatgttgggttaagtcccgcaacgagcgcaaccctcgtccttagttgccagcattgagttgggcactctggggagactgccggtgacaaaccggaggaaggtggggacgacgtcaagtcagcatgccccttatgctctgggctacacacgtgctacaatggcgcggacaaagggcagcgaacgcgcgagcgggagccaatcccaaaaaccgcgtctcagttcagatcgcaggctgcaactcgcctgcgtgaaggcggaatcgctagtaatcgcagatcagcatgctgcggtgaatacgttcccgggccttgtacacaccgcccgtcacaccatgggagctggccatgcccgaagtcggagcacccgccgaaggcagggctggtgactggggtgaagtcgtaacaaggtagccgtaccggaaggtgcggctggatcacctcctttt

SEQ ID NO: 9546 - DNA, 1472 bp, Synechococcus sp. 63AY4M1
  ref <308>: DATABASE ACCESSION NUMBER: NCBI ACCESSION: NZ_AUNA01000001.1
  ref <309>: DATABASE ENTRY DATE: 2019-04-01
  ref <313>: RELEVANT RESIDUES IN SEQ ID NO: (1)..(1472)
acgaagagtttgatcctggctcaggatgaacgctggcggtatgcctaacacatgcaagtcggacggacaccttcgggtgtcagtggcggacgggtgagtaacgcgtaggaatctacccctaggagggggataacagctggaaacggctgctaataccccatacaggcgcgagctgaaaggagcaatccgcctagggatgagcctgcgtcggattagctagttggtggggtaatggcctaccaaggcgacgatccgtagcgggtctgagaggatggcccgccacactgggactgagacacggcccagactcctacgggaggcagcagtggggaattttccgcaatgggcgaaagcctgacggagcaataccgcgtgagggaggaaggccttcgggttgtaaacctcttttctgggggacgaaggggtgacggtaccccaggaataagcctcggctaactctgtgccagcagccgcggtaagacagaggaggcgagcgttatccggagttattgggcgtaaagggtacgtaggcggctggtcaagtctggggttaaagaccacagcttaactgtgggggggccttggaaactgaccggctggagtggggcaggggttgcgggaattcccggtgtagcggtgaaatgcgtagatatcgggaagaacacctgaggcgaaagcgcgcaactgggccctaactgacgctgaggtacgaaagctaggggagcgaatgggattagataccccagtagtcctagccgtaaacgatggacactagacgttggccgtatcgacccggtcagtgtcgtagctaacgcgttaagtgtcccgcctggggagtacgcacgcaagtgtgaaactcaaaggaattgacgggggcccgcacaagcggtggagcatgtggtttaattcgatgcaaagcgaagaaccttaccagggcttgacatgccgcgaaccctgcggaaacgtgggggtgccttcgggagcgcggacacaggtggtgcatggctgtcgtcagctcgtgtcgtgagatgttgggttaagtcccgcaacgagcgcaaccctcgtccttagttgccagcattgagttgggcactctggggagactgccggtgacaaaccggaggaaggtggggacgacgtcaagtcagcatgccccttatgctctgggctacacacgtgctacaatggcgcggacaaagggcagcgaacgcgcgagcgggagccaatcccaaaaaccgcgtctcagttcagatcgcaggctgcaactcgcctgcgtgaaggcggaatcgctagtaatcgcagatcagcatgctgcggtgaatacgttcccgggccttgtacacaccgcccgtcacaccatgggagctggccatgcccgaagtcggagcacccgccgaaggcagggctggtgactggggtgaagtcgtaacaaggtagccgtaccggaaggtgcggctggatcacctcctttt

SEQ ID NO: 9547 - DNA, 1472 bp, Synechococcus sp. 63AY4M2; identical to SEQ ID NO: 9546
  ref <308>: DATABASE ACCESSION NUMBER: NCBI ACCESSION: NZ_AXUX01000001.1
  ref <309>: DATABASE ENTRY DATE: 2019-04-01
  ref <313>: RELEVANT RESIDUES IN SEQ ID NO: (1)..(1472)

SEQ ID NO: 9548 - DNA, 1472 bp, Synechococcus sp. 65AY640; identical to SEQ ID NO: 9546
  ref <308>: DATABASE ACCESSION NUMBER: NCBI ACCESSION: NZ_AXUV01000001.1
  ref <309>: DATABASE ENTRY DATE: 2019-04-01
  ref <313>: RELEVANT RESIDUES IN SEQ ID NO: (1)..(1472)

SEQ ID NO: 9549 - DNA, 1472 bp, Synechococcus sp. 65AY6A5; identical to SEQ ID NO: 9546
  ref <308>: DATABASE ACCESSION NUMBER: NCBI ACCESSION: NZ_AXUW01000001.1
  ref <309>: DATABASE ENTRY DATE: 2019-04-01
  ref <313>: RELEVANT RESIDUES IN SEQ ID NO: (1)..(1472)

SEQ ID NO: 9550 - DNA, 1472 bp, Synechococcus sp. 65AY6Li; identical to SEQ ID NO: 9546
  ref <308>: DATABASE ACCESSION NUMBER: NCBI ACCESSION: NZ_AXZO01000001.1
  ref <309>: DATABASE ENTRY DATE: 2019-04-01
  ref <313>: RELEVANT RESIDUES IN SEQ ID NO: (1)..(1472)

SEQ ID NO: 9551 - DNA, 1491 bp, Synechococcus sp. 7002
  ref <308>: DATABASE ACCESSION NUMBER: NCBI ACCESSION: NZ_FXWN01000001.1
  ref <309>: DATABASE ENTRY DATE: 2019-04-01
  ref <313>: RELEVANT RESIDUES IN SEQ ID NO: (1)..(1491)
aatatggagagtttgatcctggctcaggatgaacgctggcggtatgcctaacacatgcaagtcgaacgaagccttcgggcttagtggcggacgggtgagtaacgcgtgagaatctgccttcaggacggggacaacagttggaaacgactgctaatacccgatatgccgagaggtgaaatcttttttggcctgaagatgagctcgcgtctgattagctagttggtggtgtaagggaccaccaaggcgacgatcagtagctggtctgagaggatgagcagccacactgggactgagacacggcccagactcctacgggaggcagcagtggggaattttccgcaatgggcgaaagcctgacggagcaataccgcgtgagggaggaaggtctttggattgtaaacctcttttctcaaggaagaataaatgacggtacttgaggaataagcaccggctaactccgtgccagcagccgcggtaatacggagggtgcaagcgttatccggaattattgggcgtaaagagtccgtaggtggtcatgcaagtctgctgtcaaagcccacagcttaactgtggatcggcggtggaaactgtgtgacttgagtacggtaggggtagagggaattcccagtgtagcggtgaaatgcgtagatattgggaagaacaccggtggcgaaagcgctctactggaccgtaactgacactgagggacgaaagctaaggtagcgaaagggattagatacccctgtagtcttagccgtaaacgatggatactaggcgttgtctgtatcgacccggacagtgccgaagctaacgcgttaagtatcccgcctggggagtacgcacgcaagtgtgaaactcaaaggaattgacgggggcccgcacaagcggtggagtatgtggtttaattcgatgcaacgcgaagaaccttaccaagatttgacatcccgtgaatcttgcagagatgcgagagtgccttcgggagcacggagacaggtggtgcatggctgtcgtcagctcgtgtcgtgagatgttgggttaagtcccgcaacgagcgcaaccctcgtccttagttgccagcattaagttgggcactctagggagactgccggggacaactcggaggaaggtggggatgacgtcaagtcatcatgccccttacattttgggctacacacgtactacaatggtcgggacaaagggcagcaaccccgcgagggcaagcgaatctcatcaaacccggcctcagttcagattgcaggctgcaactcgcctgcatgaaggaggaatcgctagtaatcgcaggtcagcatactgcggtgaatccgttcccgggccttgtacacaccgcccgtcacaccatggaagctggcaacgcccgaagtcgttactctaaccgttcgcggaggagggcgccgaaggcagtgctagtgactggggtgaagtcgtaacaaggtagccgtaccggaaggtgtggctggatcacctcctttt

SEQ ID NO: 9552 - DNA, 1490 bp, Synechococcus sp. BDU 130192
  ref <308>: DATABASE ACCESSION NUMBER: NCBI ACCESSION: NZ_PCGE01000033.1
  ref <309>: DATABASE ENTRY DATE: 2019-04-01
  ref <313>: RELEVANT RESIDUES IN SEQ ID NO: (1)..(1490)
aatatggagagtttgatcctggctcaggatgaacgctggcggtatgcctaacacatgcaagtcgaacgaagccttcgggcttagtggcggacgggtgagtaacgcgtgagaatctgccttcaggacggggacaacagttggaaacgactgctaatacccgatatgccgagaggtgaaatcttttttggcctgaagatgagctcgcgtctgattagctagttggtggtgtaagggaccaccaaggcgacgatcagtagctggtctgagaggatgagcagccacactgggactgagacacggcccagactcctacgggaggcagcagtggggaattttccgcaatgggcgaaagcctgacggagcaataccgcgtgagggaggaaggtctttggattgtaaacctcttttctcagggaagaatactgacggtacctgaggaataagcaccggctaactccgtgccagcagccgcggtaatacggagggtgcaagcgttatccggaattattgggcgtaaagagtccgtaggtggtcatgcaagtctgctgtcaaagcccacagcttaactgtggatcggcggtggaaactgtgtgacttgagtacggtaggggtagagggaattcccagtgtagcggtgaaatgcgtagatattgggaagaacaccggtggcgaaagcgctctactggaccgtaactgacactgagggacgaaagctaaggtagcgaaagggattagatacccctgtagtcttagccgtaaacgatggatactaggcgttgtctgtatcgacccggacagtgccgaagctaacgcgttaagtatcccgcctggggagtacgcacgcaagtgtgaaactcaaaggaattgacgggggcccgcacaagcggtggagtatgtggtttaattcgatgcaacgcgaagaaccttaccaagatttgacatcccgtgaatcttgcagagatgcgagagtgccttcgggagcacggagacaggtggtgcatggctgtcgtcagctcgtgtcgtgagatgttgggttaagtcccgcaacgagcgcaaccctcgtccttagttgccagcattaagttgggcactctagggagactgccggggacaactcggaggaaggtggggatgacgtcaagtcatcatgccccttacattttgggctacacacgtactacaatggtcgggacaaagggcagcaaccccgcgagggcaagcgaatctcatcaaacccggcctcagttcagattgcaggctgcaactcgcctgcatgaaggaggaatcgctagtaatcgcaggtcagcatactgcggtgaatccgttcccgggccttgtacacaccgcccgtcacaccatggaagctggcaacgcccgaagtcgttactctaaccgttcgcggaggagggcgccgaaggcagtgctagtgactggggtgaagtcgtaacaaggtagccgtaccggaaggtgtggctggatcacctcctttt

SEQ ID NO: 9553 - DNA, 1484 bp, Synechococcus sp. BL107
  ref <308>: DATABASE ACCESSION NUMBER: NCBI ACCESSION: NZ_DS022298.1
  ref <309>: DATABASE ENTRY DATE: 2019-04-01
  ref <313>: RELEVANT RESIDUES IN SEQ ID NO: (1)..(1484)
aacggagagtttgatcctggctcaggatgaacgctggcggcgtgcttaacacatgcaagtcgaacgaaccttcgggttagtggcggacgggtgagtaacgcgtgagaatctgccctcaggagggggataacagctggaaacggctgctaataccccatatgccgcgaggtgaaatgaatttcgcctgaggatgagctcgcgtctgattagctagttggtgtaggtaatggctcaccaaggcatcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttatcaaggaagaagatctgacggtacttgatgaataagccacggctaattccgtgccagcagccgcggtaatacgggagtggcaagcgttatccggaattattgggcgtaaagcgtccgcaggcggcccttcaagtctgctgttaaaaagtggagcttaactccatcatggcagtggaaactgaggggcttgagtgtggtaggggcagagggaattcccggtgtagcggtgaaatgcgtagatatcgggaagaacaccagtggcgaaggcgctctgctgggccatcactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaatctcttggaaacgagagagtgccttcgggaacgcagtgacaggtggtgcatggctgtcgtcagctcgtgtcgtgagatgttgggttaagtcccgcaacgagcgcaacccacgtctttagttgccagcatttagttgggcactctagagagaccgccggtgataaaccggaggaaggtgtggatgacgtcaagtcatcatgccccttacatcctgggctacacacgtactacaatgctacggacaaagggcagcaagttcgcgaggacaagcaaatcccataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccacgcccgaagccgttactccaacccttgtggaggaggacgtcgaaggtggggctgatgactggggtgaagtcgtaacaaggtatccgtaccggaaggtgcggatggatcacctcctaa

SEQ ID NO: 9554 - DNA, 870 bp, Synechococcus sp. CB0205
  ref <308>: DATABASE ACCESSION NUMBER: NCBI ACCESSION: NZ_ADXM01000002.1
  ref <309>: DATABASE ENTRY DATE: 2019-04-01
  ref <313>: RELEVANT RESIDUES IN SEQ ID NO: (1)..(870)
aacggagagtttgatcctggctcaggatgaacgctggcggcgtgcttaacacatgcaagtcgaacgaaccttcgggttagtggcggacgggtgagtaacgcgtgagaatctgccctcaggagggggataacggttggaaacgaccgctaataccccatatgccgcgaggtgaaatgaatttcgcctgaggatgagctcgcgtctgattagttagttggtggggtaaaggcctaccaagacatcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttatcaaggaagaagatctgacggtacttgatgaataagccacggctaattccgtgccagcagccgcggtaatacgggagtggcaagcgttatccggaattattgggcgtaaagcgtccgcaggcggtctgtcaagtctgctgttaaagcgtggagcttaactccatttcggcagtggaaactgacagactagagtgtggtaggggcagagggaattcccggtgtagcggtgaaatgcgtagatatcgggaagaacaccagtggcgaaggcgctctgctgggccataactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacggggg

SEQ ID NO: 9555 - DNA, 1483 bp, Synechococcus sp. CC9311
  ref <308>: DATABASE ACCESSION NUMBER: NCBI ACCESSION: NC_008319.1
  ref <309>: DATABASE ENTRY DATE: 2019-04-01
  ref <313>: RELEVANT RESIDUES IN SEQ ID NO: (1)..(1483)
aacggagagtttgatcctggctcaggatgaacgctggcggcgtgcttaacacatgcaagtcgaacgaaccttcgggttagtggcggacgggtgagtaacgcgtgggaatctgccctcaggagggggataacggttggaaacggccgctaataccccatatgccgagaggtgaaatgaatttcgcctgaggatgagcccgcgtctgattagctagttggtgaggtaagagctcaccaaggcatcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttatcaaggaagaagatctgacggtacttgatgaataagccacggctaattccgtgccagcagccgcggtaatacgggagtggcaagcgttatccggaattattgggcgtaaagcgtccgcaggcggccctacaagtctgctgttaaaaagtggagcttaactccatcatggcagtggaaactgttgggcttgagtgtggtaggggcagagggaattcccggtgtagcggtgaaatgcgtagatatcgggaagaacaccagtggcgaaggcgctctgctgggccatcactgacgctcatggacgaaagccaggggagcgaaagggattagatacccctgtagtcctggccgtaaacgatgaacactaggtgtcgggggaatcaacccctccggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaatctcttggaaacttgagagtgccttcgggagcgcagtgacaggtggtgcatggctgtcgtcagctcgtgtcgtgagatgttgggttaagtcccgcaacgagcgcaacccacgtctttagttgccagcatttagttgggcactctagagagaccgccggtgataaaccggaggaaggtgtggatgacgtcaagtcatcatgccccttacatcctgggctacacacgtactacaatgctacggacaaagggcagcaagttcgcgaggacaagcaaatcccataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccacgcccgaagccgttactccaacccttgtggaggaggacgtcgaaggtggggctgatgactggggtgaagtcgtaacaaggtagccgtaccggaaggtgcggctggatcacctcctaa

SEQ ID NO: 9556 - DNA, 1484 bp, Synechococcus sp. CC9605
  ref <308>: DATABASE ACCESSION NUMBER: NCBI ACCESSION: NC_007516.1
  ref <309>: DATABASE ENTRY DATE: 2019-04-01
  ref <313>: RELEVANT RESIDUES IN SEQ ID NO: (1)..(1484)
aacggagagtttgatcctggctcaggatgaacgctggcggcgtgcttaacacatgcaagtcgaacgaaccttcgggttagtggcggacgggtgagtaacgcgtgagaatctgccctcaggagggggacaacagctggaaacggctgctaataccccatatgccgcgaggtgaaatgaatttcgcctgaggatgagctcgcgtctgattagctagttggtgtaggtaatggctcaccaaggcatcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttatcaaggaagaagatctgacggtacttgatgaataagccacggctaattccgtgccagcagccgcggtaatacgggagtggcaagcgttatccggaattattgggcgtaaagcgtccgcaggcggcccttcaagtctgctgttaaaaagtggagcttaactccatcatggcagtggaaactgttgggcttgagtgtggtaggggcagagggaattcccggtgtagcggtgaaatgcgtagatatcgggaagaacaccagtggcgaaggcgctctgctgggccatcactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaatctcttggaaacaggagagtgccttcgggaacgcagtgacaggtggtgcatggctgtcgtcagctcgtgtcgtgagatgttgggttaagtcccgcaacgagcgcaacccacgtctttagttgccagcatttagttgggcactctagagagactgccggtgataaaccggaggaaggtgtggatgacgtcaagtcatcatgccccttacatcctgggctacacacgtactacaatgctacggacaaagggctgcaagttcgcgaggacaagcaaatcccataaaccgtggctcagttcagatcgtaggctgcaactcgcctacgtgaaggcggaatcgctagtaatcgcaggtcagcatactgcggtgaatacgttcccgggccttgtacacaccgcccgtcacaccatggaagttggccacgcccgaagccgttactccaacccttgtggaggaggacgtcgaaggtggggctgatgactggggtgaagtcgtaacaaggtatccgtaccggaaggtgcggatggatcacctcctaa

SEQ ID NO: 9557 - DNA, 1483 bp, Synechococcus sp. CC9616
  ref <308>: DATABASE ACCESSION NUMBER: NCBI ACCESSION: NZ_KI911558.1
  ref <309>: DATABASE ENTRY DATE: 2019-04-01
  ref <313>: RELEVANT RESIDUES IN SEQ ID NO: (1)..(1483)
aacggagagtttgatcctggctcaggatgaacgctggcggcgtgcttaacacatgcaagtcgaacgaaccttcgggttagtggcggacgggtgagtaacgcgtgagaatctgccctcaggagggggataacggttggaaacggccgctaataccccatatgccgcgaggtgaaatgaatttcgcctgaggatgagctcgcgtctgattagctagttggtgtaggtaatggctcaccaaggcatcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttctcaaggaagaagatctgacggtacttgaggaataagccacggctaattccgtgccagcagccgcggtaatacgggagtggcaagcgttatccggaattattgggcgtaaagcgtccgcaggcggcccttcaagtctgctgttaaagcgtggagcttaactccatcatggcagtggaaactgttgggcttgagtgtggtaggggcagagggaattcccggtgtagcggtgaaatgcgtagatatcgggaagaacaccagtggcgaaggcgctctgctgggccatcactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaacctcttggaaacgagagggtgccttcgggaacgcagtgacaggtggtgcatggctgtcgtcagctcgtgtcgtgagatgttgggttaagtcccgcaacgagcgcaacccacgtctttagttgccagcatttagttgggcactctagagagaccgccggtgataaaccggaggaaggtgtggatgacgtcaagtcatcatgccccttacatcctgggctacacacgtactacaatgctacggacagagggcagcaagttcgcgaggacaagcaaatcccgtaaaccgtagctcagttcagatcgtaggctgcaactcgcctacgtgaaggaggaatcgctagtaatcgcaggtcagcatactgcggtgaatacgttcccgggccttgtacacaccgcccgtcacaccatggaagttggccatgcccgaagccgttactccaaccctcgggaggaggacgtcgaaggtggggctgatgactggggtgaagtcgtaacaaggtatccgtaccggaaggtgcggatggatcacctcctaa

SEQ ID NO: 9558 - DNA, 1484 bp, Synechococcus sp. CC9902; identical to SEQ ID NO: 9553
  ref <308>: DATABASE ACCESSION NUMBER: NCBI ACCESSION: NC_007513.1
  ref <309>: DATABASE ENTRY DATE: 2019-04-01
  ref <313>: RELEVANT RESIDUES IN SEQ ID NO: (1)..(1484)

SEQ ID NO: 9559 - DNA, 1483 bp, Synechococcus sp. GFB01
  misc_feature (71)..(71): n is a, c, g, or t
  misc_feature (1264)..(1264): n is a, c, g, or t
  ref <308>: DATABASE ACCESSION NUMBER: NCBI ACCESSION: NZ_LFEK01000058.1
  ref <309>: DATABASE ENTRY DATE: 2019-04-01
  ref <313>: RELEVANT RESIDUES IN SEQ ID NO: (1)..(1483)
aacggagagtttgatcctggctcaggatgaacgctggcggcgtgcttaacacatgcaagtcgaacgaaccntcgggttagtggcggacgggtgagtaacgcgtgagaatctgccctcaggagggggataacggctggaaacggccgctaataccccatatgccgagaggtgaaatgaatttcgcctgaggatgagctcgcgtctgattagctagttggtggggtaagagcctaccaaggcgtcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttctcaaggaagaagatctgacggtacttgaggaataagccacggctaattccgtgccagcagccgcggtaatacgggagtggcaagcgttatccggaattattgggcgtaaagcgtccgcaggcggcctcgtaagtctgttgtcaaagcgtggagcttaactccatttcggcaatggaaactgtgaggcttgagtgtggtaggggcagagggaattcccggtgtagcggtgaaatgcgtagatatcgggaagaacaccagtggcgaaggcgctctgctgggccataactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaacccctgagaaatcggggggtgccttcgggagcgcagtgacaggtggtgcatggctgtcgtcagctcgtgtcgtgagatgttgggttaagtcccgcaacgagcgcaacccacgtctttagttgccagcattcagttgggcactctagagagaccgccggtgataaaccggaggaaggtgtggatgacgtcaagtcatcatgccccttacatcctgggctacacacgtactacaatgctacggacaaagggcagcaaactcgcgagagctagcaaatcccataaaccgtggctcagttcagatcgtaggctgcaactcgnctacgtgaaggaggaatcgctagtaatcgcaggtcagcatactgcggtgaatacgttcccgggccttgtacacaccgcccgtcacaccatggaagttggccacgcccgaagccgttactccaacccttgtggaggaggacgtcgaaggtggggctgatgactggggtgaagtcgtaacaaggtagccgtaccggaaggtgcggctggatcacctcctaa

SEQ ID NO: 9560 - DNA, 1472 bp, Synechococcus sp. JA-2-3B a 2-13
  ref <308>: DATABASE ACCESSION NUMBER: NCBI ACCESSION: NC_007776.1
  ref <309>: DATABASE ENTRY DATE: 2019-04-01
  ref <313>: RELEVANT RESIDUES IN SEQ ID NO: (1)..(1472)
cacggagagtttgatcctggctcaggatgaacgctggcggtatgcttaacacatgcaagtcgcacggacaccttcgggtgttagtggcggacgggtgagtaacacgtaggaatctaccctcaggcgggggataacagctggaaacggctgctaataccccatacaggcggaagctgaaaggagcaatccacctgaggatgagcctgcgtcggattagctagttggtggggtaatggcctaccaaggcgacgatccgtagcgggtctgagaggatggcccgccacactgggactgagacacggcccagactcctacgggaggcagcagtggggaattttccgcaatgggcgcaagcctgacggagcaataccgcgtgagggaggaaggcccttgggttgtaaacctcttttctgggggacgaaagctgacggtaccccaggaataagcctcggctaactccgtgccagcagccgcggtaagacggaggaggcaagcgttatccggaattattgggcgtaaagggtacgtaggcggctggtcaagtctggggtcaaaggccacagctcaactgtgggaaggccctggaaactgaccggctagagtgaggtaggggttgcgggaattcccggtgtagcggtgaaatgcgtagagatcgggaagaacacctgaggcggaagcgcgcaactgggcctcaactgacgctgaggtacgaaagctaggggagcgaatgggattagataccccagtagtcctagccgtaaacgatggacactagacgttggccgtatcgacccggtcagtgtcggagctaacgcgttaagtgtcccgcctggggagtacgcacgcaagtgtgaaactcaaaggaattgacgggggcccgcacaagcggtggagcatgtggtttaattcgatgcaacgcgaagaaccttaccagggcttgacatgccgcgaaccctgcggaaacgtgggggtgccttcgggagcgcggacacaggtggtgcatggctgtcgtcagctcgtgtcgtgagatgttgggttaagtcccgcaacgagcgcaacccttgttcctagttgccagcattgagttgggcactctagggagactgccggtgacaaaccggaggaaggtgaggatgacgtcaagtcagcatgccccttacgctctgggctacacacgtgctacaatggcgcggacaaagggtcgcgagcgcgcgagcgtgagccaatcccaaaaaccgcgtctcagttcagatcgcaggctgcaactcgcctgcgtgaaggcggaatcgctagtaatcgcagatcagcatgctgcggtgaatacgttcccgggccttgtacacaccgcccgtcacaccatgggagctggccatgcccgaagtcggagcacccgccgaaggcagggctggtgactggggtgaagtcgtaacaaggtagccgtaccggaaggtgcggctggatcacctcctttt

SEQ ID NO: 9561 - DNA, 1472 bp, Synechococcus sp. JA-3-3Ab; identical to SEQ ID NO: 9546
  ref <308>: DATABASE ACCESSION NUMBER: NCBI ACCESSION: NC_007775.1
  ref <309>: DATABASE ENTRY DATE: 2019-04-01
  ref <313>: RELEVANT RESIDUES IN SEQ ID NO: (1)..(1472)

SEQ ID NO: 9562 - DNA, 1482 bp, Synechococcus sp. KORDI-100
  ref <308>: DATABASE ACCESSION NUMBER: NCBI ACCESSION: NZ_CP006269.1
  ref <309>: DATABASE ENTRY DATE: 2019-04-01
  ref <313>: RELEVANT RESIDUES IN SEQ ID NO: (1)..(1482)
aacggagagtttgatcctggctcaggatgaacgctggcggcgtgcctaacacatgcaagtcgaacgaaccttcgggttagtggcggacgggtgagtaacgcgtgggaatctgccctcaggagggggataacggctggaaacggccgctaataccccatatgccgagaggtgaaatgaatttcgcctgaggatgagcccgcgtctgattagcttgttggtgaggtaatggctcaccaaggcttcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttctcaaggaagaagatctgacggtacttgaggaataagccacggctaattccgtgccagcagccgcggtaatacgggagtggcaagcgttatccggaattattgggcgtaaagcgtccgcaggcggcccttcaagtctgctgttaaagcgtggagcttaactccatcatggcagtggaaactgttgggcttgagtgtggtaggggcagagggaattcccggtgtagcggtgaaatgcgtagatatcgggaagaacaccagtggcgaaggcgctctgctgggccatcactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaacctcttggaaacaggagggtgccttcgggaacgcagtgacaggtggtgcatggctgtcgtcagctcgtgtcgtgagatgttgggttaagtcccgcaacgagcgcaacccacgtctttagttgccagcatttagttgggcactctagagagaccgccggtgataaaccggaggaaggtgtggatgacgtcaagtcatcatgccccttacatcctgggctacacacgtactacaatgctacggacagagggctgcaagttcgcgaggacaagcaaatcccataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccacgcccgaagccgttactccaaccctcgggaggaggacgtcgaaggtggggctgatgactggggtgaagtcgtaacaaggtagccgtaccggaaggtgcggctggatcacctcctaa

SEQ ID NO: 9563 - DNA, 1484 bp, Synechococcus sp. KORDI-49
  ref <308>: DATABASE ACCESSION NUMBER: NCBI ACCESSION: NZ_CP006270.1
  ref <309>: DATABASE ENTRY DATE: 2019-04-01
  ref <313>: RELEVANT RESIDUES IN SEQ ID NO: (1)..(1484)
aacggagagtttgatcctggctcaggatgaacgctggcggcgtgcttaacacatgcaagtcgaacgaaccttcgggttagtggcggacgggtgagtaacgcgtgagaatctgccctcaggagggggataacagctggaaacggctgctaataccccatatgccgcgaggtgaaatgaatttcgcctgaggatgagctcgcgtctgattagctagttggtgtaggtaaaggctcaccaaggcatcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttatcaaggaagaagatctgacggtacttgatgaataagccacggctaattccgtgccagcagccgcggtaatacgggagtggcaagcgttatccggaattattgggcgtaaagcgtccgcaggcggcccagaaagtctgctgttaaaacgtggagcttaactccatcatggcagtggaaactgttgggcttgagtgtggtaggggcagagggaattcccggtgtagcggtgaaatgcgtagatatcgggaagaacaccagtggcgaaggcgctctgctgggccataactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaacctcttggaaacgagagggtgccttcgggaacgcagtgacaggtggtgcatggctgtcgtcagctcgtgtcgtgagatgttgggttaagtcccgcaacgagcgcaacccacgtctttagttgccagcatttagttgggcactctagagagaccgccggtgataaaccggaggaaggtgtggatgacgtcaagtcatcatgccccttacatcctgggctacacacgtactacaatgctacggacaaagggcagcaagttcgcgaggacaagcaaatcccataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccacgcccgaagccgttactccaacccttgtggaggaggacgtcgaaggtggggctgatgactggggtgaagtcgtaacaaggtatccgtaccggaaggtgcggatggatcacctcctaa

SEQ ID NO: 9564 - DNA, 1484 bp, Synechococcus sp. KORDI-52
  ref <308>: DATABASE ACCESSION NUMBER: NCBI ACCESSION: NZ_CP006271.1
  ref <309>: DATABASE ENTRY DATE: 2019-04-01
  ref <313>: RELEVANT RESIDUES IN SEQ ID NO: (1)..(1484)
aacggagagtttgatcctggctcaggatgaacgctggcggcgtgcttaacacatgcaagtcgaacgaaccttcgggttagtggcggacgggtgagtaacgcgtgagaatctgccctcaggagggggataacggttggaaacgaccgctaataccccatatgccgcgaggtgaaatgaatttcgcctgaggatgagctcgcgtctgattagctagttggtgtaggtaatggctcaccaaggcatcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttatcaaggaagaagatctgacggtacttgatgaataagccacggctaattccgtgccagcagccgcggtaatacgggagtggcaagcgttatccggaattattgggcgtaaagcgtccgcaggcggcccttcaagtctgctgttaaagcgtggagcttaactccatcatggcagtggaaactgttgggcttgagtgtggtaggggcagagggaattcccggtgtagcggtgaaatgcgtagatatcgggaagaacaccagtggcgaaggcgctctgctgggccatcactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaatctcttggaaacgagagagtgccttcgggaacgcagtgacaggtggtgcatggctgtcgtcagctcgtgtcgtgagatgttgggttaagtcccgcaacgagcgcaacccacgtctttagttgccagcattcagttgggcactctagagagaccgccggtgataaaccggaggaaggtgtggatgacgtcaagtcatcatgccccttacatcctgggctacacacgtactacaatgctacggacaaagggcagcaagttcgcgaggacaagcaaatcccataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccacgcccgaagccgttactccaacccttgtggaggaggacgtcgaaggtggggctgatgactggggtgaagtcgtaacaaggtatccgtaccggaaggtgcggatggatcacctcctaa

SEQ ID NO: 9565 - DNA, 1483 bp, Synechococcus sp. MIT S9504
  ref <308>: DATABASE ACCESSION NUMBER: NCBI ACCESSION: NZ_LVHT01000025.1
  ref <309>: DATABASE ENTRY DATE: 2019-04-01
  ref <313>: RELEVANT RESIDUES IN SEQ ID NO: (1)..(1483)
aacggagagtttgatcctggctcaggatgaacgctggcggcgtgcttaacacatgcaagtcgaacgaaccttcgggttagtggcggacgggtgagtaacgcgtgggaatctgccctcaggagggggataacggttggaaacgaccgctaataccccatatgccgagaggtgaaatgaatttcgcctgaggatgagcccgcgtctgattagctagttggtgaggtaagagctcaccaaggcatcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttctcaaggaagaagatctgacggtacttgaggaataagccacggctaattccgtgccagcagccgcggtaatacgggagtggcaagcgttatccggaattattgggcgtaaagcgtccgcaggcggcctttcaagtctgctgttaaagcgtggagcttaactccatcatggcagtggaaactgttgggcttgagtgtggtaggggcagagggaattcccggtgtagcggtgaaatgcgtagatatcgggaagaacaccagtggcgaaggcgctctgctgggccataactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaatctcttggaaacgagagagtgccctcgggaacgcagtgacaggtggtgcatggctgtcgtcagctcgtgtcgtgagatgttgggttaagtcccgcaacgagcgcaacccacgtctttagttgccagcatttagttgggcactctagagagaccgccggtgataaaccggaggaaggtgtggatgacgtcaagtcatcatgccccttacatcctgggctacacacgtactacaatgctacggacaaagagcagcaagttcgcgaggacaagcaaatctcataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccacgcccgaagccgttactccaacccttgtggaggaggacgtcgaaggtggggctgatgactggggtgaagtcgtaacaaggtagccgtaccggaaggtgcggctggatcacctcctaa

SEQ ID NO: 9566 - DNA, 1483 bp, Synechococcus sp. MIT S9508
  ref <308>: DATABASE ACCESSION NUMBER: NCBI ACCESSION: NZ_LVHU01000023.1
  ref <309>: DATABASE ENTRY DATE: 2019-04-01
  ref <313>: RELEVANT RESIDUES IN SEQ ID NO: (1)..(1483)
aacggagagtttgatcctggctcaggatgaacgctggcggcgtgcttaacacatgcaagtcgaacgaaccttcgggttagtggcggacgggtgagtaacgcgtgggaatctgccctcaggagggggataacggctggaaacggccgctaataccccatatgccgagaggtgaaatgaatttcgcctgaggatgagcccgcgtctgattagctagttggtgaggtaagagctcaccaaggcatcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttctcaaggaagaagatctgacggtacttgaggaataagccacggctaattccgtgccagcagccgcggtaatacgggagtggcaagcgttatccggaattattgggcgtaaagcgtccgcaggcggcctttcaagtctgctgttaaaacgtggagcttaactccatcatggcagtggaaactgttgggcttgagtgtggtaggggcagagggaattcccggtgtagcggtgaaatgcgtagatatcgggaagaacaccagtggcgaaggcgctctgctgggccataactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaatctcttggaaacgagagagtgccctcgggaacgcagtgacaggtggtgcatggctgtcgtcagctcgtgtcgtgagatgttgggttaagtcccgcaacgagcgcaacccacgtctttagttgccagcatttagttgggcactctagagagaccgccggtgataaaccggaggaaggtgtggatgacgtcaagtcatcatgccccttacatcctgggctacacacgtactacaatgctacggacaaagagcagcaagttcgcgaggacaagcaaatctcataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccacgcccgaagccgttactccaacccttgtggaggaggacgtcgaaggtggggctgatgactggggtgaagtcgtaacaaggtagccgtaccggaaggtgcggctggatcacctcctaa

SEQ ID NO: 9567 - DNA, 1483 bp, Synechococcus sp. MIT S9509; identical to SEQ ID NO: 9565
  ref <308>: DATABASE ACCESSION NUMBER: NCBI ACCESSION: NZ_LVHV01000022.1
  ref <309>: DATABASE ENTRY DATE: 2019-04-01
  ref <313>: RELEVANT RESIDUES IN SEQ ID NO: (1)..(1483)

SEQ ID NO: 9568 - DNA, 1490 bp, Synechococcus sp. NIES-970
  ref <308>: DATABASE ACCESSION NUMBER: NCBI ACCESSION: NZ_AP017959.1
  ref <309>: DATABASE ENTRY DATE: 2019-04-01
  ref <313>: RELEVANT RESIDUES IN SEQ ID NO: (1)..(1490)
tatggagagtttgatcctggctcaggatgaacgctggcggtatgcctaacacatgcaagtcgaacgaagtcttcggacttagtggcggacgggtgagtaacgcgtgagaatctgccttcaggacggggacaacagttggaaacgactgctaatacccgatatgccgagaggtgaaatcttttttggcctgaagatgagctcgcgtctgattagctagttggtggggtaagagcctaccaaggcgacgatcagtagctggtctgagaggatgagcagccacactgggactgagacacggcccagactcctacgggaggcagcagtggggaattttccgcaatgggcgaaagcctgacggagcaataccgcgtgagggaggaaggtctttggattgtaaacctcttttctcaaggaagaacaaaatgacggtacttgaggaataagcaccggctaactccgtgccagcagccgcggtaatacggagggtgcaagcgttatccggaattattgggcgtaaagagtccgtaggtggttcagcaagtctgctgtcaaagcccgcagcttaactgcggagaggcggtggaaactgttgaactagagtgcggtaggggtagagggaattcccagtgtagcggtgaaatgcgtagatattgggaagaacaccggtggcgaaagcgctctactggaccgtaactgacactgagggacgaaagccaaggtagcgaaagggattagatacccctgtagtcttggccgtaaacgatggatactaggcgttgtctgtatcgacccggacagtgccgaagctaacgcgttaagtatcccgcctggggagtacgcacgcaagtgtgaaactcaaaggaattgacgggggcccgcacaagcggtggagtatgtggtttaattcgatgcaacgcgaagaaccttaccaagatttgacatcccatgaatcctgccgagaggcgggagtgccttcgggaacatggagacaggtggtgcatggctgtcgtcagctcgtgtcgtgagatgttgggttaagtcccgcaacgagcgcaaccctcgtccttagttgccagcattaagttgggcactctagggagactgccggggacaactcggaggaaggtggggatgacgtcaagtcatcatgccccttacattttgggctacacacgtactacaatggtcgggacaaagggcagcaaccccgcgagggcaagcgaatctcatcaaacccggcctcagttcagattgcaggctgcaactcgcctgcatgaaggaggaatcgctagtaatcgcaggtcagcatactgcggtgaatccgttcccgggccttgtacacaccgcccgtcacaccatggaagctggcaatgcccgaagtcgttactctaaccgttcgcggaggagggcgccgaaggcagtgctagtgactggggtgaagtcgtaacaaggtagccgtaccggaaggtgtggctggatcacctcctttt

SEQ ID NO: 9569 - DNA, 1490 bp, Synechococcus sp. NKBG042902
  ref <308>: DATABASE ACCESSION NUMBER: NCBI ACCESSION: NZ_BAWS01000049.1
  ref <309>: DATABASE ENTRY DATE: 2019-04-01
  ref <313>: RELEVANT RESIDUES IN SEQ ID NO: (1)..(1490)
aatatggagagtttgatcctggctcaggatgaacgctggcggtatgcctaacacatgcaagtcgaacgaagccttcgggcttagtggcggacgggtgagtaacgcgtgagaatctgccttcaggacggggacaacagttggaaacgactgctaatacccgatatgccgagaggtgaaatcttttttggcctgaagatgagctcgcgtctgattagctagttggtggtgtaagggaccaccaaggcgacgatcagtagctggtctgagaggatgagcagccacactgggactgagacacggcccagactcctacgggaggcagcagtggggaattttccgcaatgggcgaaagcctgacggagcaataccgcgtgagggaggaaggtctttggattgtaaacctcttttctcagggaagaatattgacggtacctgaggaataagcaccggctaactccgtgccagcagccgcggtaatacggagggtgcaagcgttatccggaattattgggcgtaaagagtccgtaggtggtcatgcaagtctgctgtcaaagcccacagcttaactgtggatcggcggtggaaactgtgtgacttgagtacggtaggggtagagggaattcccagtgtagcggtgaaatgcgtagatattgggaagaacaccggtggcgaaagcgctctactggaccgtaactgacactgagggacgaaagctaaggtagcgaaagggattagatacccctgtagtcttagccgtaaacgatggatactaggcgttgtctgtatcgacccggacagtgccgaagctaacgcgttaagtatcccgcctggggagtacgcacgcaagtgtgaaactcaaaggaattgacgggggcccgcacaagcggtggagtatgtggtttaattcgatgcaacgcgaagaaccttaccaagatttgacatcccgtgaatcttgcagagatgcgagagtgccttcgggagcacggagacaggtggtgcatggctgtcgtcagctcgtgtcgtgagatgttgggttaagtcccgcaacgagcgcaaccctcgtccttagttgccagcattaagttgggcactctagggagactgccggggacaactcggaggaaggtggggatgacgtcaagtcatcatgccccttacattttgggctacacacgtactacaatggtcgggacaaagggcagcaaccccgcgagggcaagcgaatctcatcaaacccggcctcagttcagattgcaggctgcaactcgcctgcatgaaggaggaatcgctagtaatcgcaggtcagcatactgcggtgaatccgttcccgggccttgtacacaccgcccgtcacaccatggaagctggcaacgcccgaagtcgttactctaaccgttcgcggaggagggcgccgaaggcagtgctagtgactggggtgaagtcgtaacaaggtagccgtaccggaaggtgtggctggatcacctcctttt

SEQ ID NO: 9570 - DNA, 1490 bp, Synechococcus sp. NKBG15041c; identical to SEQ ID NO: 9568
  ref <308>: DATABASE ACCESSION NUMBER: NCBI ACCESSION: NZ_BAUB01000037.1
  ref <309>: DATABASE ENTRY DATE: 2019-04-01
  ref <313>: RELEVANT RESIDUES IN SEQ ID NO: (1)..(1490)

SEQ ID NO: 9571 - DNA, 1491 bp, Synechococcus sp. OG1; identical to SEQ ID NO: 9551
  ref <308>: DATABASE ACCESSION NUMBER: NCBI ACCESSION: NZ_FXBO01000001.1
  ref <309>: DATABASE ENTRY DATE: 2019-04-01
  ref <313>: RELEVANT RESIDUES IN SEQ ID NO: (1)..(1491)

SEQ ID NO: 9572 - DNA, 1483 bp, Synechococcus sp. P1
  ref <308>: DATABASE ACCESSION NUMBER: NCBI ACCESSION: NZ_UCOB01000013.1
  ref <309>: DATABASE ENTRY DATE: 2019-04-01
  ref <313>: RELEVANT RESIDUES IN SEQ ID NO: (1)..(1483)
aacggagagtttgatcctggctcaggatgaacgctggcggcgtgcttaacacatgcaagtcgaacgaaccttcgggttagtggcggacgggtgagtaacgcgtgagaatctgccctcaggagggggacaacagctggaaacggctgctaataccccatatgccgagaggtgaaatgaatttcgcctgaggatgagctcgcgtctgattagcttgttggtgaggtaagagctcaccaaggcatcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttctcaaggaagaagatctgacggtacttgaggaataagccacggctaattccgtgccagcagccgcggtaatacgggagtggcaagcgttatccggaattattgggcgtaaagcgtccgcaggcggcccaaaaagtctgctgttaaaaagtggagcttaactccatcatggcagtggaaactgttgggctagagtgtggtaggggcagagggaattcccggtgtagcggtgaaatgcgtagatatcgggaagaacaccagtggcgaaggcgctctgctgggccatcactgacgctcatggacgaaagccaggggagcgaaagggattagatacccctgtagtcctggccgtaaacgatgaacactaggtgtcgggggaatcgacccctccggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaatctcctggaaacgggagagtgccttcgggaacgcagtgacaggtggtgcatggctgtcgtcagctcgtgtcgtgagatgttgggttaagtcccgcaacgagcgcaacccacgtctttagttgccagcatttagttgggcactctagagagaccgccggtgataaaccggaggaaggtgtggatgacgtcaagtcatcatgccccttacatcctgggctacacacgtactacaatgctacggacaaagggcagcaaactcgcgagagctagcaaatcccataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccacgcccgaagccgttactccaacccttgtggaggaggacgtcgaaggtggggctgatgactggggtgaagtcgtaacaaggtagccgtaccggaaggtgcggctggatcacctcctaa

SEQ ID NO: 9573 - DNA, 1495 bp, Synechococcus sp. PCC 6312
  ref <308>: DATABASE ACCESSION NUMBER: NCBI ACCESSION: NC_019680.1
  ref <309>: DATABASE ENTRY DATE: 2019-04-01
  ref <313>: RELEVANT RESIDUES IN SEQ ID NO: (1)..(1495)
attcaaaatggagagtttgatcctggctcaggatgaacgctggcggtctgcttaacacatgcaagtcgaacgaagtcttcggacttagtggcggacgggtgagtaacacgtaagaatctgccctcaggagggggataacagcgggaaactgctgctaataccccatatgccgaaaggtgaaatgttttttcgcctggggatgagcttgcgtctgattagcttgttggtggggtaacggcctaccaaggcaacgatcagtagctggtctgagaggatgatcagccacactgggactgagacacggcccagactcctacgggaggcagcagtggggaattttccgcaatgggcgaaagcctgacggagcaagaccgcgtgagggatgaaggtttttggattgtaaacctcttttatcagggaagaacacaatgacggtacctgatgaataagcatcggctaactccgtgccagcagccgcggtaagacggaggatgcaagcgttatccggaattattgggcgtaaagcgtccgcaggtggctgttcaagtctgctgtcaaagcccgaggctcaacctcggatcggcggtggaaactgaacggctagagtatggcaggggttaggggaattcccggtgtagcggtgaaatgcgtagatatcgggaagaacaccagcgacgaaagtgcctaactgggccattactgacactcatggacgaaagctaggggagcgaaagggattagatacccctgtagtcctagccgtaaacgatggacactaggtgttgctggtatccactccagcagtgtcgtagccaacgcgttaagtgtcccgcctggggagtacgcacgcaagtgtgaaactcaaaggaattgacgggggcccgcacaagcggtggagtatgtggtttaattcgatgcaacgcgaagaaccttaccagggtttgacatgtcgcgaatctcggggaaacctgagagtgccgtaaggagcgcgaacacaggtggtgcatggctgtcgtcagctcgtgtcgtgagatgttgggttaagtcccgcaacgagcgcaaccctcgtccttagttgccagcattaagttgggcactctagggagactgccggtgacaaaccggaggaaggtggggatgacgtcaagtcatcatgccccttacatcctgggctacacacgtactacaatgctacggacagagggttgccaactcgcgagagtgcgctaatcccttaaaccgtggctcagttcagattgtaggctgcaactcgcctacatgaaggcggaatcgctagtaatcgcaggtcagcatactgcggtgaatacgttcccgggccttgtacacaccgcccgtcacaccatggaagttggccacgcccgaagtcgttactccaacccgaaagggagggggacgccgaaggcagggctgatgactggggtgaagtcgtaacaaggtagccgtaccggaaggtgtggctggatcacctcctttt

SEQ ID NO: 9574 - DNA, 1491 bp, Synechococcus sp. PCC 7002; identical to SEQ ID NO: 9551
  ref <308>: DATABASE ACCESSION NUMBER: NCBI ACCESSION: NC_010475.1
  ref <309>: DATABASE ENTRY DATE: 2019-04-01
  ref <313>: RELEVANT RESIDUES IN SEQ ID NO: (1)..(1491)

SEQ ID NO: 9575 - DNA, 1491 bp, Synechococcus sp. PCC 7003
  ref <308>: DATABASE ACCESSION NUMBER: NCBI ACCESSION: NZ_CP016474.1
  ref <309>: DATABASE ENTRY DATE: 2019-04-01
  ref <313>: RELEVANT RESIDUES IN SEQ ID NO: (1)..(1491)
aatatggagagtttgatcctggctcaggatgaacgctggcggtatgcctaacacatgcaagtcgaacgaagccttcgggcttagtggcggacgggtgagtaacgcgtgagaatctgccttcaggacggggacaacagttggaaacgactgctaatacccgatatgccgagaggtgaaaagttttttcgcctgaagatgagctcgcgtctgattagctagttggtggtgtaagggaccaccaaggcgacgatcagtagctggtctgagaggatgagcagccacactgggactgagacacggcccagactcctacgggaggcagcagtggggaattttccgcaatgggcgaaagcctgacggagcaataccgcgtgagggaggaaggtctttggattgtaaacctcttttctcaaggaagaataaatgacggtacttgaggaataagcaccggctaactccgtgccagcagccgcggtaatacggagggtgcaagcgttatccggaattattgggcgtaaagagtccgtaggtggtcatgcaagtctgctgtcaaagcccacagcttaactgtggatcggcggtggaaactgtgtgacttgagtacggtaggggtagagggaattcccagtgtagcggtgaaatgcgtagatattgggaagaacaccggtggcgaaagcgctctactggaccgtaactgacactgagggacgaaagctaaggtagcgaaagggattagatacccctgtagtcttagccgtaaacgatggatactaggcgttgtctgtatcgacccggacagtgccgaagctaacgcgttaagtatcccgcctggggagtacgcacgcaagtgtgaaactcaaaggaattgacgggggcccgcacaagcggtggagtatgtggtttaattcgatgcaacgcgaagaaccttaccaagatttgacatcccgtgaatcttgcagagatgcgagagtgccttcgggagcacggagacaggtggtgcatggctgtcgtcagctcgtgtcgtgagatgttgggttaagtcccgcaacgagcgcaaccctcgtccttagttgccagcattaagttgggcactctagggagactgccggggacaactcggaggaaggtggggatgacgtcaagtcatcatgccccttacattttgggctacacacgtactacaatggtcgggacaaagggcagcaaccccgcgagggcaagcgaatctcatcaaacccggcctcagttcagattgcaggctgcaactcgcctgcatgaaggaggaatcgctagtaatcgcaggtcagcatactgcggtgaatccgttcccgggccttgtacacaccgcccgtcacaccatggaagctggcaacgcccgaagtcgttactctaaccgttcgcggaggagggcgccgaaggcagtgctagtgactggggtgaagtcgtaacaaggtagccgtaccggaaggtgtggctggatcacctcctttt

SEQ ID NO: 9576 - DNA, 1490 bp, Synechococcus sp. PCC 7117; identical to SEQ ID NO: 9569
  ref <308>: DATABASE ACCESSION NUMBER: NCBI ACCESSION: NZ_CP016477.1
  ref <309>: DATABASE ENTRY DATE: 2019-04-01
  ref <313>: RELEVANT RESIDUES IN SEQ ID NO: (1)..(1490)

SEQ ID NO: 9577 - DNA, 1490 bp, Synechococcus sp. PCC 73109; identical to SEQ ID NO: 9552
  ref <308>: DATABASE ACCESSION NUMBER: NCBI ACCESSION: NZ_CP013998.1
  ref <309>: DATABASE ENTRY DATE: 2019-04-01
  ref <313>: RELEVANT RESIDUES IN SEQ ID NO: (1)..(1490)

SEQ ID NO: 9578 - DNA, 1492 bp, Synechococcus sp. PCC 7335
  ref <308>: DATABASE ACCESSION NUMBER: NCBI ACCESSION: NZ_DS989904.1
  ref <309>: DATABASE ENTRY DATE: 2019-04-01
  ref <313>: RELEVANT RESIDUES IN SEQ ID NO: (1)..(1492)
taaaatggagagtttgatcctggctcaggatgaacgctggcggcgtgcttaacacatgcaagtcgaacggaccttttcggaggttagtggcggacgggtgagtaacgcgtgaggatctgcctataggatggggacaacagggagaaattcctgctaacacccgatgtgccgagaggtgaaatattaatagcctgtagatgagctcgcgtctgattagctagttggtggggtaaaggcttaccaaggcgacgatcagtagctggtctgagaggacgatcagccacactgggactgagacacggcccagactcctacgggaggcagcagtggggaattttccgcaatgggcgcaagcctgacggagcaacgccgcgtgagggaggaaggcctgtgggttgtaaacctcttttctcagggaagaagattctgacggtacctgaggaatcagcatcggctaactccgtgccagcagccgcggtaagacggaggatgcaagcgttatccggaattattgggcgtaaagcgtccgtaggcggtttagaaagtcagttgttaaagcccacagctcaactgtggatgggcaattgaaactactagactagagagtggtaggggtagagggaattcctagtgtagcggtgaaatgcgtagatattaggaagaacaccagtggcgaaggcgctctactgggccattactgacgctgatggacgaaagctaggggagcgaaagggattagatacccctgtagtcctagctgtaaacgatggacactaggtgttgcgcgtatcgacccgtgcagtatcgaagcaaacgcgttaagtgtcccgcctggggagtacgcacgcaagtgtgaaactcaaaggaattgacgggggcccgcacaagcggtggagtatgtggtttaattcgatgcaacgcgaagaaccttaccagggattgacatcctacgaagacttttgaaagagagttgtgccttcgggaacgtagagacaggtggtgcatggctgtcgtcagctcgtgtcgtgagatgttgggttaagtcccgcaacgagcgcaaccctcgtccttagttgccatcattaagttgggcactttaaggagactgccggtgacaaaccggaggaaggtggggatgacgtcaagtcatcatgccccttacatcctgggctacacacgtactacaatgcaacggacaaagggcagccaactagcgatagtgagctaatcccataaaccgttgctcagttcagattgcaggctgcaactcgcctgcatgaaggcggaatcgctagtaatcgcaggtcagcatactgcggtgaatacgttcccgggccttgtacacaccgcccgtcacaccatggaagttggccacgcccgaagtcgttaccccaacccttgtggagggggacgccgaaggcagggctgatgactggggtgaagtcgtaacaaggtagccgtaccggaaggtgtggctggatcacctccttag

SEQ ID NO: 9579 - DNA, 1491 bp, Synechococcus sp. PCC 7336
  ref <308>: DATABASE ACCESSION NUMBER: NCBI ACCESSION: NZ_CM001776.1
  ref <309>: DATABASE ENTRY DATE: 2019-04-01
  ref <313>: RELEVANT RESIDUES IN SEQ ID NO: (1)..(1491)
aaacggagagtttgatcctggctcaggatgaacgctggcggtatgcctaacacatgcaagtcgaacgagcttttcggagcgagtggcggacgggtgagtaacgcgtaaggacctgcccttaagcgggggacaacagttggaaacgactgctaataccccataagccgagaggtaaaagatttatcacttagggatggacttgcgtcagattaggtagttggtggggtaagagcctaccaagccgacgatctgtagctgttctgagagggagagcagccacactgggactgagacacggcccagactcctacgggaggcagcagtggggaattttccgcaatgggcgaaagcctgacggagcaataccgcgtgaatgaagaaggctttcgggtcgtaaagttcttttatcagggaagaagattgacggtacctgatgaatcagcatcggctaactccgtgccagcagccgcggtaagacggaggatgcaagcgttatccggaattattgggcgtaaagcgtacgtaggcggctgagcaagtctggtgttaaaggccacggcctaaccgtggaagggcactggaaactgcgcagctcgagtgcggtaggggtagagggaattcccggtgtagcggtgaaatgcgtagatatcgggaagaacaccagtggcgaaagcgctctactgggccgcaactgacgctgaggtacgaaagctagggtagcgaaagggattagatacccctgtagtcctagccgtaaacgatggacactaggtgttggacgtatcgacccgttcagtaccgtagctaacgcgttaagtgtcccgcctggggagtacgcacgcaagtgtgaaactcaaaggaattgacgggggcccgcacaagcggtggagcatgtggtttaattcgatgcaacgcgaagaaccttaccagggtttgacatcccgcgaacaccttggaaacagggtggtgccttcgggaacgcggagacaggtggtgcatggctgtcgtcagctcgtgtcgtgagatgttgggttaagtcccgcaacgagcgcaaccctcgtggttagttgccagcattaagttgggcactctagccagactgccggtgacaaaccggaggaaggtggggatgacgtcaagtcagcatgccccttacatcctgggctacacacgtgctacaatgccacggacaaagagcagccaactagcaatagcgagcaaatctcataaaccgtggctcagttcagattgcaggctgcaactcgcctgcatgaaggaggaatcgctagtaatcgcaggtcagcatactgcggtgaatacgttcccgggccttgtacacaccgcccgtcacaccatggaagtcggccacgcccgaagtcgttattctaaccgtaaggagggaggcgccgaaggcagggctggtaactggggtgaagtcgtaacaaggtagccgtaccggaaggtgcggctggatcacctcctttctaggga

SEQ ID NO: 9580 - DNA, 1485 bp, Synechococcus sp. PCC 7502
  ref <308>: DATABASE ACCESSION NUMBER: NCBI ACCESSION: NC_019702.1
  ref <309>: DATABASE ENTRY DATE: 2019-04-01
  ref <313>: RELEVANT RESIDUES IN SEQ ID NO: (1)..(1485)
atcatggagagtttgatcctggctcaggatgaacgctggcggtatgcttaacacatgcaagtcgaacggagtagcaatacttagtggcggacgggtgagtaacgcgtaagaatctgcctataggacggggataacggctagaaatggtcgctaaaacccgatgtgccgagaggtgaaatatttatagcctgtagatgagcttgcgtctgattagctagttggagtggtaacggcacaccaaggcgacaatcagtaactggtctgagaggatgaccagtcacactgggactgagacacggcccagactcctacgggaggcagcagtggggaattttccgcaatgggcgaaagcctgacggagcaataccgcgtgagggatgaaggttcgtggattgtaaacctcttttttcagggaagataatgacggtacctgaagaataagcatcggctaactccgtgccagcagccgcggtaagacggaggatgcaagcgttatccggaattattgggcgtaaagcgtacgcaggtggcacatcaagtctgttgttaaagcgcggagctcaactccgtaaaagcgatagaaactggtgagctagagtatggtaggggcaggaggaattcccagtgtagcggtgaaatgcgtagatattgggaagaacaccagcggcgaaagcgtcctgccaagccaaaactgacactcatgtacgaaagctaggggagcgaatgggattagataccccagtagtcctagccgtaaacgatgggtactaggtgttgggagtatcgaccctctcagtgccgtagctaacgcgttaagtaccccgcctggggagtacggtcgcaagattgaaactcaaaggaattgacgggggcccgcacaagcggtggagtatgtggtttaattcgatgcaacgcgaagaaccttaccaagacttgacatcctatgaatcctgctgaaaggtgggagtgccttcgggagcatagagacaggtggtgcatggctgtcgtcagctcgtgtcgtgagatgttgggttaagtcccgcaacgagcgcaaccctcatttttagttgccatcattcagttgggcactctagagagaccgccggtgacaaaccggaggaaggtggggatgacgtcaagtcagcatgccccttacgtcttgggctacacacgtactacaatggctgggacaaagagtcgcaagtatgcgaatacaagctaatctcgtaaacccagtcttagttcagatcgtaggctgcaactcgcctacgtgaaggcggaatcgctagtaatcgcagatcagaatgctgcggtgaatacgttcccgggccttgtacacaccgcccgtcacaccatggaagttggtcacgcccgaagtcgttattctaaccgcaaggaagaaggcgcctaaggcagggctgatgactggggtgaagtcgtaacaaggtagccgtaccggaaggtgcggctggatcacctcctttt

SEQ ID NO: 9581 - DNA, 1490 bp, Synechococcus sp. PCC 8807
  ref <308>: DATABASE ACCESSION NUMBER: NCBI ACCESSION: NZ_CP016483.1
  ref <309>: DATABASE ENTRY DATE: 2019-04-01
  ref <313>: RELEVANT RESIDUES IN SEQ ID NO: (1)..(1490)
aatatggagagtttgatcctggctcaggatgaacgctggcggtatgcctaacacatgcaagtcgaacgaagccttcgggcttagtggcggacgggtgagtaacgcgtgagaatctgccttcaggacggggacaacagttggaaacgactgctaatacccgatatgccgagaggtgaaatcttttttggcctgaagatgagctcgcgtctgattagctagttggtggtgtaagggaccaccaaggcgacgatcagtagctggtctgagaggatgagcagccacactgggactgagacacggcccagactcctacgggaggcagcagtggggaattttccgcaatgggcgaaagcctgacggagcaataccgcgtgagggaggaaggtctttggattgtaaacctcttttctcagggaagaatattgacggtacctgaggaataagcaccggctaactccgtgccagcagccgcggtaatacggagggtgcaagcgttatccggaattattgggcgtaaagagtccgtaggtggtcatgcaagtctgctgtcaaagcccacagctcaactgtggatcggcggtggaaactgtgtgacttgagtacggtaggggtagagggaattcccagtgtagcggtgaaatgcgtagatattgggaagaacaccggtggcgaaagcgctctactggaccgtaactgacactgagggacgaaagctaaggtagcgaaagggattagatacccctgtagtcttagccgtaaacgatggatactaggcgttgtctgtatcgacccggacagtgccgaagctaacgcgttaagtatcccgcctggggagtacgcacgcaagtgtgaaactcaaaggaattgacgggggcccgcacaagcggtggagtatgtggtttaattcgatgcaacgcgaagaaccttaccaagatttgacatcccgtgaatcttgcagagatgcgagagtgccttcgggagcacggagacaggtggtgcatggctgtcgtcagctcgtgtcgtgagatgttgggttaagtcccgcaacgagcgcaaccctcgtccttagttgccagcattaagttgggcactctagggagactgccggggacaactcggaggaaggtggggatgacgtcaagtcatcatgccccttacattttgggctacacacgtactacaatggtcgggacaaagggcagcaaccccgcgagggcaagcgaatctcatcaaacccggcctcagttcagattgcaggctgcaactcgcctgcatgaaggaggaatcgctagtaatcgcaggtcagcatactgcggtgaatccgttcccgggccttgtacacaccgcccgtcacaccatggaagctggcaacgcccgaagtcgttactctaaccgttcgcggaggagggcgccgaaggcagtgctagtgactggggtgaagtcgtaacaaggtagccgtaccggaaggtgtggctggatcacctcctttt

SEQ ID NO: 9582 - DNA, 1483 bp, Synechococcus sp. RCC307
  ref <308>: DATABASE ACCESSION NUMBER: NCBI ACCESSION: NC_009482.1
  ref <309>: DATABASE ENTRY DATE: 2019-04-01
  ref <313>: RELEVANT RESIDUES IN SEQ ID NO: (1)..(1483)
aacggagagtttgatcctggctcaggatgaacgctggcggcgtgcttaacacatgcaagtcgaacgaaccttcgggttagtggcggacgggtgagtaacgcgtgagaatctgccctcaggagggggataacggctggaaacggccgctaataccccatatgccgagaggtgaaatgaatttcgcctgaggatgagctcgcgtctgattagcttgttggtggggtaatggcctaccaaggcaacgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttatcaaggaagaagatctgacggtacttgatgaataagccacggctaattccgtgccagcagccgcggtaatacgggagtggcaagcgttatccggaattattgggcgtaaagcgtccgcaggcggcctgacaagtctgctgttaaagcgtggagcttaactccatttcagcagtggaaactgtcaggcttgagtgtggtaggggcagagggaattcccggtgtagcggtgaaatgcgtagatatcgggaagaacaccagtggcgaaagcgctctgctgggccatcactgacgctcatggacgaaagccaggggagcgaaagggattagatacccctgtagtcctggccgtaaacgatgaacactaggtgtcgggggaatcgacccctccggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggcttgacatcctgcgaacctctgggaaaccggagggtgccttcgggaacgcagtgacaggtggtgcatggctgtcgtcagctcgtgtcgtgagatgttgggttaagtcccgcaacgagcgcaacccacgtctttagttgccagcatttagttgggcactctagagagaccgccggtgacaaaccggaggaaggtgtggatgacgtcaagtcatcatgccccttacgtcctgggctacacacgtactacaatgctacggacaaagggcagcaagttcgcgaggacaagcaaatcccataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccacgcccgaagtcgttactccaaccctctgggaggaggacgccgaaggtggggctgatgactggggtgaagtcgtaacaaggtagccgtaccggaaggtgcggctggatcacctcctaa

SEQ ID NO: 9583 - DNA, 1483 bp, Synechococcus sp. RS9916
  ref <308>: DATABASE ACCESSION NUMBER: NCBI ACCESSION: NZ_DS022299.1
  ref <309>: DATABASE ENTRY DATE: 2019-04-01
  ref <313>: RELEVANT RESIDUES IN SEQ ID NO: (1)..(1483)
aacggagagtttgatcctggctcaggatgaacgctggcggcgtgcttaacacatgcaagtcgaacgaaccttcgggttagtggcggacgggtgagtaacgcgtgagaatctgccctcaggagggggacaacagctggaaacggctgctaataccccatatgccgcgaggtgaaatgaatttcgcctgaggatgagctcgcgtctgattagctagttggtgaggtaatggctcaccaaggcatcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttatcaaggaagaagatctgacggtacttgatgaataagccacggctaattccgtgccagcagccgcggtaatacgggagtggcaagcgttatccggaattattgggcgtaaagcgtccgcaggcggtccagaaagtctgctgttaaaaagtggagcttaactccatcatggcagtggaaacttctggactagagtgtggtaggggcagagggaattcccggtgtagcggtgaaatgcgtagatatcgggaagaacaccagtggcgaaggcgctctgctgggccataactgacgctcatggacgaaagccaggggagcgaaagggattagatacccctgtagtcctggccgtaaacgatgaacactaggtgtcgggggaatcgacccctccggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaatttctgggaaaccggaaagtgccttcgggagcgcagtgacaggtggtgcatggctgtcgtcagctcgtgtcgtgagatgttgggttaagtcccgcaacgagcgcaacccacgtctttagttgccagcattgagttgggcactctagagagaccgccggtgataaaccggaggaaggtgtggatgacgtcaagtcatcatgccccttacatcctgggctacacacgtactacaatgctacggacaaagggcagcaaactcgcgagagctagcaaatcccataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccacgcccgaagccgttactccaacccttgtggaggaggacgtcgaaggtggggctgatgactggggtgaagtcgtaacaaggtagccgtaccggaaggtgcggctggatcacctcctaa

SEQ ID NO: 9584 - DNA, 1484 bp, Synechococcus sp. RS9917
  ref <308>: DATABASE ACCESSION NUMBER: NCBI ACCESSION: NZ_CH724158.1
  ref <309>: DATABASE ENTRY DATE: 2019-04-01
  ref <313>: RELEVANT RESIDUES IN SEQ ID NO: (1)..(1484)
caacggagagtttgatcctggctcaggatgaacgctggcggcgtgcttaacacatgcaagtcgaacgaaccttcgggttagtggcggacgggtgagtaacgcgtgagaatctgccctcaggagggggacaacagctggaaacggctgctaataccccatatgccgcgaggtgaaatgaaattcgcctgaggatgagctcgcgtctgattagctagttggtggggtaagagcctaccaaggcatcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttctcaaggaagaagaactgacggtacttgaggaataagccacggctaattccgtgccagcagccgcggtaatacgggagtggcaagcgttatccggaattattgggcgtaaagcgtccgcaggcggcccttcaagtctgctgttaaaaagtggagcttaactccatcgtggcagtggaaactgttgggctagagtgtggtaggggcagagggaattcccggtgtagcggtgaaatgcgtagatatcgggaagaacaccagtggcgaaggcgctctgctgggccataactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaatctcctggaaacgggagagtgccttcgggaacgcagtgacaggtggtgcatggctgtcgtcagctcgtgtcgtgagatgttgggttaagtcccgcaacgagcgcaacccacgtctttagttgccagcattcagttgggcactctagagagaccgccggtgataaaccggaggaaggtgtggatgacgtcaagtcatcatgccccttacatcctgggctacacacgtactacaatgctacggacaaagggcagcaaactcgcgagagctagcaaatcccataaaccgtagctcagttcagatcgtaggctgcaactcgcctacgtgaaggaggaatcgctagtaatcgcaggtcagcatactgcggtgaatacgttcccgggccttgtacacaccgcccgtcacaccatggaagttggccacgcccgaagccgttactccaacccttgtggaggaggacgtcgaaggtggggctgatgactggggtgaagtcgtaacaaggtagccgtaccggaaggtgcggctggatcacctcctaa

SEQ ID NO: 9585 - DNA, 1486 bp, Synechococcus sp. SynAce01
  ref <308>: DATABASE ACCESSION NUMBER: NCBI ACCESSION: NZ_CP018091.1
  ref <309>: DATABASE ENTRY DATE: 2019-04-01
  ref <313>: RELEVANT RESIDUES IN SEQ ID NO: (1)..(1486)
acaacggagagtttgatcctggctcaggatgaacgctggcggcgtgcttaacacatgcaagtcgaacgggccttcgggctagtggcggacgggtgagtaacgcgtgagaatctgccctcaggagggggataacagctggaaacggctgctaataccccatatgccgagaggtgaaacgaatttcgcctgaggatgagctcgcgtctgattagcttgttggtgaggtaagggctcaccaaggcatcgatcagtagctggtctgagaggatgatcagccacactgggactgagacacggcccagactcctacgggaggcagcagtggggaattttccgcaatgggcgcaagcctgacggagcaacgccgcgtgagggacgaaggcctctgggctgtaaacctcttttctcaaggaagaagacatgacggtacttgaggaataagccacggctaattccgtgccagcagccgcggtaatacgggagtggcaagcgttatccggaattattgggcgtaaagcgtccgcaggcggcccagaaagtctgttgttaaaaagtggagctcaactccatccaggcaatggaaactactgggctagagtgtggtaggggcagagggaattcccggtgtagcggtgaaatgcgtagatatcgggaagaacaccagtggcgaaggcgctctgctgggccataactgacgctcatggacgaaagctaggggagcgaaagggattagatacccctgtagtcctagccgtaaacgatgaacactaggtgtcgggagaattatccctctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggcttgacatcctgcgaacccctgagagatcggggggtgccttcgggaacgcagtgacaggtggtgcatggctgtcgtcagctcgtgtcgtgagatgttgggttaagtcccgcaacgagcgcaacccacgtctttagttgccagcatttagttgggcactctagagagaccgccggtgataaaccggaggaaggtgtggatgacgtcaagtcatcatgccccttacgtcctgggctacacacgtactacaatgctacggacaaagggcagcaaactcgcgagagctagcaaatcccataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccatgcccgaagtcgttactccaacccgtaagggaggaggacgccgaaggtggggctgatgactggggtgaagtcgtaacaaggtagccgtaccggaaggtgcggctggatcacctcctaa

SEQ ID NO: 9586 - DNA, 1491 bp, Synechococcus sp. UTEX 2973
  ref <308>: DATABASE ACCESSION NUMBER: NCBI ACCESSION: NZ_CP006471.1
  ref <309>: DATABASE ENTRY DATE: 2019-04-01
  ref <313>: RELEVANT RESIDUES IN SEQ ID NO: (1)..(1491)
caaaatggagagtttgatcctggctcaggatgaacgctggcggcgtgcttaacacatgcaagtcgaacgggctcttcggagctagtggcggacgggtgagtaacgcgtgagaatctgcctacaggacggggacaacagttggaaacgactgctaatacccgatgtgccgagaggtgaaacatttatggcctgtagatgagctcgcgtctgattagctagttggtggggtaagggcctaccaaggcgacgatcagtagctggtctgagaggatgatcagccacactgggactgagacacggcccagactcctacgggaggcagcagtggggaattttccgcaatgggcgcaagcctgacggagcaacgccgcgtgggggaggaaggtttttggactgtaaaccccttttctcagggaagaagaaagtgacggtacctgaggaataagcctcggctaattccgtgccagcagccgcggtaatacgggagaggcaagcgttatccggaattattgggcgtaaagcgtccgcaggcggttaatcaagtctgttgtcaaagcgtggggctcaacctcatacaggcaatggaaactgattgactagagtatggtaggggtagcgggaattccaggtgtagcggtgaaatgcgtagatatctggaagaacaccagcggcgaaagcgcgctactgggccataactgacgctcatggacgaaagctaggggagcgaaagggattagatacccctgtagtcctagccgtaaacgatgaacactaggtgttgcgtgaatcgacccgcgcagtgccgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcccccgaatctcttggaaacgagagagtgccttcgggagcggggagacaggtggtgcatggctgtcgtcagctcgtgtcgtgagatgttgggttaagtcccgcaacgagcgcaacccacgtttttagttgccatcattcagttgggcactctagagaaactgccggtgacaaaccggaggaaggtgtggacgacgtcaagtcatcatgccccttacatcctgggctacacacgtactacaatgctccggacagcgagacgcgaagccgcgaggtgaagcaaatctcccaaaccggggctcagttcagattgcaggctgcaactcgcctgcatgaaggcggaatcgctagtaatcgcaggtcagcatactgcggtgaatacgttcccgggccttgtacacaccgcccgtcacaccatggaagttggccatgcccgaagtcgttaccctaaccgttcgcggaggggggcgccgaaggtagggctgatgactggggtgaagtcgtaacaaggtagccgtaccggaaggtgtggctggatcacctcctttc

SEQ ID NO: 9587 - DNA, 1482 bp, Synechococcus sp. WH 7803
  ref <308>: DATABASE ACCESSION NUMBER: NCBI ACCESSION: NC_009481.1
  ref <309>: DATABASE ENTRY DATE: 2019-04-01
  ref <313>: RELEVANT RESIDUES IN SEQ ID NO: (1)..(1482)
aacggagagtttgatcctggctcaggatgaacgctggcggcgtgcttaacacatgcaagtcgaacgaaccttcgggttagtggcggacgggtgagtaacgcgtgggaatctgccctcaggagggggataacggctggaaacggccgctaataccccatatgccgagaggtgaaatgaatttcgcctgaggatgagcccgcgtctgattagctagttggtgaggtaagagctcaccaaggcatcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttctcaaggaagaagatctgacggtacttgaggaataagccacggctaattccgtgccagcagccgcggtaatacgggagtggcaagcgttatccggaattattgggcgtaaagcgtccgcaggcggcccttcaagtctgctgttaaaaagtggagcttaactccatcatggcagtggaaactgttgggcttgagtgtggtaggggcagagggaattcccggtgtagcggtgaaatgcgtagatatcgggaagaacaccagtggcgaaggcgctctgctgggccataactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaacctcttggaaacgagagggtgccttcgggaacgcagtgacaggtggtgcatggctgtcgtcagctcgtgtcgtgagatgttgggttaagtcccgcaacgagcgcaacccacgtctttagttgccagcatttagttgggcactctagagagaccgccggtgataaaccggaggaaggtgtggatgacgtcaagtcatcatgccccttacatcctgggctacacacgtactacaatgctacggacaaagagcagcaagttcgcgaggacaagcaaatctcataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccacgcccgaagccgttactccaaccctcgggaggaggacgtcgaaggtggggctgatgactggggtgaagtcgtaacaaggtagccgtaccggaaggtgcggctggatcacctcctaa

SEQ ID NO: 9588 - DNA, 1483 bp, Synechococcus sp. WH 7805
  ref <308>: DATABASE ACCESSION NUMBER: NCBI ACCESSION: NZ_CH724168.1
  ref <309>: DATABASE ENTRY DATE: 2019-04-01
  ref <313>: RELEVANT RESIDUES IN SEQ ID NO: (1)..(1483)
aacggagagtttgatcctggctcaggatgaacgctggcggcgtgcttaacacatgcaagtcgaacgaaccttcgggtgagtggcggacgggtgagtaacgcgtgggaatctgccctcaggagggggataacggctggaaacggccgctaataccccatatgccgagaggtgaaatgaatttcgcctgaggatgagcccgcgtctgattagctagttggtgaggtaagagctcaccaaggcatcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttctcaaggaagaagatctgacggtacttgaggaataagccacggctaattccgtgccagcagccgcggtaatacgggagtggcaagcgttatccggaattattgggcgtaaagcgtccgcaggcggcccttcaagtctgctgttaaaacgtggagcttaactccatcatggcagtggaaactgttgggctcgagtgtggtaggggcagagggaattcccggtgtagcggtgaaatgcgtagatatcgggaagaacaccagtggcgaaggcgctctgctgggccataactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaacctcttggaaacgagagggtgccttcgggagcgcagtgacaggtggtgcatggctgtcgtcagctcgtgtcgtgagatgttgggttaagtcccgcaacgagcgcaacccacgtctttagttgccagcatttagttgggcactctagagagaccgccggtgataaaccggaggaaggtgtggatgacgtcaagtcatcatgccccttacatcctgggctacacacgtactacaatgctacggacaaagagcagcaagttcgcgaggacaagcaaatctcataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccacgcccgaagccgttactccaacccttgtggaggaggacgtcgaaggtggggctgatgactggggtgaagtcgtaacaaggtagccgtaccggaaggtgcggctggatcacctcctaa

SEQ ID NO: 9589 - DNA, 1483 bp, Synechococcus sp. WH 8016
  ref <308>: DATABASE ACCESSION NUMBER: NCBI ACCESSION: NZ_AGIK01000004.1
  ref <309>: DATABASE ENTRY DATE: 2019-04-01
  ref <313>: RELEVANT RESIDUES IN SEQ ID NO: (1)..(1483)
aacggagagtttgatcctggctcaggatgaacgctggcggcgtgcttaacacatgcaagtcgaacgaaccttcgggttagtggcggacgggtgagtaacgcgtgggaatctgccctcaggagggggataacggttggaaacggccgctaataccccatatgccgagaggtgaaatgaatttcgcctgaggatgagcccgcgtctgattagctagttggtgaggtaagagctcaccaaggcatcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttatcaaggaagaagatctgacggtacttgatgaataagccacggctaattccgtgccagcagccgcggtaatacgggagtggcaagcgttatccggaattattgggcgtaaagcgtccgcaggcggcccttcaagtctgctgttaaaaagtggagcttaactccatcatggcagtggaaactgttgggcttgagtgtggtaggggcagagggaattcccggtgtagcggtgaaatgcgtagatatcgggaagaacaccagtggcgaaggcgctctgctgggccatcactgacgctcatggacgaaagccaggggagcgaaagggattagatacccctgtagtcctggccgtaaacgatgaacactaggtgtcgggggaatcgacccctccggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaatctcttggaaacttgagagtgccttcgggagcgcagtgacaggtggtgcatggctgtcgtcagctcgtgtcgtgagatgttgggttaagtcccgcaacgagcgcaacccacgtctttagttgccagcatttagttgggcactctagagagaccgccggtgataaaccggaggaaggtgtggatgacgtcaagtcatcatgccccttacatcctgggctacacacgtactacaatgctacggacaaagggcagcaagttcgcgaggacaagcaaatcccataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccacgcccgaagccgttactccaacccttgtggaggaggacgtcgaaggtggggctgatgactggggtgaagtcgtaacaaggtagccgtaccggaaggtgcggctggatcacctcctaa

SEQ ID NO: 9590 - DNA, 1483 bp, Synechococcus sp. WH 8020
  ref <308>: DATABASE ACCESSION NUMBER: NCBI ACCESSION: NZ_CP011941.1
  ref <309>: DATABASE ENTRY DATE: 2019-04-01
  ref <313>: RELEVANT RESIDUES IN SEQ ID NO: (1)..(1483)
aacggagagtttgatcctggctcaggatgaacgctggcggcgtgcttaacacatgcaagtcgaacgaaccttcgggttagtggcggacgggtgagtaacgcgtgggaatctgccctcaggagggggataacggttggaaacggccgctaataccccatatgccgagaggtgaaatgaatttcgcctgaggatgagcccgcgtctgattagctagttggtgaggtaagagctcaccaaggcatcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttatcaaggaagaagatctgacggtacttgatgaataagccacggctaattccgtgccagcagccgcggtaatacgggagtggcaagcgttatccggaattattgggcgtaaagcgtccgcaggcggccctacaagtctgctgttaaaaagtggagcttaactccatcatggcagtggaaactgttgggcttgagtgtggtaggggcagagggaattcccggtgtagcggtgaaatgcgtagatatcgggaagaacaccagtggcgaaggcgctctgctgggccatcactgacgctcatggacgaaagccaggggagcgaaagggattagatacccctgtagtcctggccgtaaacgatgaacactaggtgtcgggggaatcgacccctccggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaatctcttggaaacttgagagtgccttcgggagcgcagtgacaggtggtgcatggctgtcgtcagctcgtgtcgtgagatgttgggttaagtcccgcaacgagcgcaacccacgtctttagttgccagcatttagttgggcactctagagagaccgccggtgataaaccggaggaaggtgtggatgacgtcaagtcatcatgccccttacatcctgggctacacacgtactacaatgctacggacaaagggcagcaagttcgcgaggacaagcaaatcccataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccacgcccgaagccgttactccaacccttgtggaggaggacgtcgaaggtggggctgatgactggggtgaagtcgtaacaaggtagccgtaccggaaggtgcggctggatcacctcctaa

SEQ ID NO: 9591 - DNA, 1483 bp, Synechococcus sp. WH 8101
  ref <308>: DATABASE ACCESSION NUMBER: NCBI ACCESSION: NZ_CP035914.1
  ref <309>: DATABASE ENTRY DATE: 2019-04-01
  ref <313>: RELEVANT RESIDUES IN SEQ ID NO: (1)..(1483)
aacggagagtttgatcctggctcaggatgaacgctggcggcgtgcttaacacatgcaagtcgaacgaaccttcgggttagtggcggacgggtgagtaacgcgtgagaatctgccctcaggagggggacaacagctggaaacggctgctaataccccatatgccgcgaggtgaaacgaatttcgcctgaggatgagctcgcgtctgattagctagttggtggggtaaaggcctaccaaggcatcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttctcaaggaagaagatctgacggtacttgaggaataagccacggctaattccgtgccagcagccgcggtaatacgggagtggcaagcgttatccggaattattgggcgtaaagcgtccgcaggcggcccttcaagtctgctgttaaaaagtggagcttaactccatcgtggcagtggaaactgttgggctagagtgtggtaggggcagagggaattcccggtgtagcggtgaaatgcgtagatatcgggaagaacaccagtggcgaaggcgctctgctgggccataactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaatctcctggaaacgggagagtgccttcgggaacgcagtgacaggtggtgcatggctgtcgtcagctcgtgtcgtgagatgttgggttaagtcccgcaacgagcgcaacccacgtctttagttgccagcattcagttgggcactctagagagaccgccggtgataaaccggaggaaggtgtggatgacgtcaagtcatcatgccccttacatcctgggctacacacgtactacaatgctacggacaaagggcagcaaactcgcgagagctagcaaatcccataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccacgcccgaagccgttactccaacccttgtggaggaggacgtcgaaggtggggctgatgactggggtgaagtcgtaacaaggtagccgtaccggaaggtgcggctggatcacctcctaa

SEQ ID NO: 9592 - DNA, 1482 bp, Synechococcus sp. WH 8102
  ref <308>: DATABASE ACCESSION NUMBER: NCBI ACCESSION: NC_005070.1
  ref <309>: DATABASE ENTRY DATE: 2019-04-01
  ref <313>: RELEVANT RESIDUES IN SEQ ID NO: (1)..(1482)
aacggagagtttgatcctggctcaggatgaacgctggcggcgtgcttaacacatgcaagtcgaacgaaccttcgggttagtggcggacgggtgagtaacgcgtgagaatctgccctcaggagggggataacggttggaaacgaccgctaataccccatatgccgcgaggtgaaatgaatttcgcctgaggatgagctcgcgtctgattagctagttggtggggtaaaggcctaccaaggcatcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttatcaaggaagaagatctgacggtacttgatgaataagccacggctaattccgtgccagcagccgcggtaatacgggagtggcaagcgttatccggaattattgggcgtaaagcgtccgcaggcggcccttcaagtctgctgttaaagagtggagcttaactccatcatggcagtggaaactgttgggcttgagtgtggtaggggcagagggaattcccggtgtagcggtgaaatgcgtagatatcgggaagaacaccagtggcgaaggcgctctgctgggccatcactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaatctcttggaaacgagagagtgccttcgggaacgcagtgacaggtggtgcatggctgtcgtcagctcgtgtcgtgagatgttgggttaagtcccgcaacgagcgcaacccacgtctttagttgccagcatttagttgggcactctagagagaccgccggtgataaaccggaggaaggtgtggatgacgtcaagtcatcatgccccttacatcctgggctacacacgtactacaatgctacggacaaagggcagcaagttcgcgaggacaagcaaatcccataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccacgcccgaagccgttactccaaccctcgggaggaggacgtcgaaggtggggctgatgactggggtgaagtcgtaacaaggtatccgtaccggaaggtgcggatggatcacctcctaa

SEQ ID NO: 9593 - DNA, 1482 bp, Synechococcus sp. WH 8103
  ref <308>: DATABASE ACCESSION NUMBER: NCBI ACCESSION: NZ_LN847356.1
  ref <309>: DATABASE ENTRY DATE: 2019-04-01
  ref <313>: RELEVANT RESIDUES IN SEQ ID NO: (1)..(1482)
aacggagagtttgatcctggctcaggatgaacgctggcggcgtgcttaacacatgcaagtcgaacgaaccttcgggttagtggcggacgggtgagtaacgcgtgagaatctgccctcaggagggggataacggttggaaacgaccgctaataccccatatgccgcgaggtgaaatgaatttcgcctgaggatgagctcgcgtctgattagctagttggtggggtaaaggcctaccaaggcatcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttatcaaggaagaagatctgacggtacttgatgaataagccacggctaattccgtgccagcagccgcggtaatacgggagtggcaagcgttatccggaattattgggcgtaaagcgtccgcaggcggcccttcaagtctgctgttaaaaagtggagcttaactccatcatggcagtggaaactgttgggcttgagtgtggtaggggcagagggaattcccggtgtagcggtgaaatgcgtagatatcgggaagaacaccagtggcgaaggcgctctgctgggccatcactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaatctcttggaaacgagagagtgccttcgggaacgcagtgacaggtggtgcatggctgtcgtcagctcgtgtcgtgagatgttgggttaagtcccgcaacgagcgcaacccacgtctttagttgccagcatttagttgggcactctagagagaccgccggtgataaaccggaggaaggtgtggatgacgtcaagtcatcatgccccttacatcctgggctacacacgtactacaatgctacggacaaagggcagcaagttcgcgaggacaagcaaatcccataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccacgcccgaagccgttactccaaccctcgggaggaggacgtcgaaggtggggctgatgactggggtgaagtcgtaacaaggtatccgtaccggaaggtgcggatggatcacctcctaa

SEQ ID NO: 9594 - DNA, 1484 bp, Synechococcus sp. WH 8109; identical to SEQ ID NO: 9556
  ref <308>: DATABASE ACCESSION NUMBER: NCBI ACCESSION: NZ_CP006882.1
  ref <309>: DATABASE ENTRY DATE: 2019-04-01
  ref <313>: RELEVANT RESIDUES IN SEQ ID NO: (1)..(1484)

SEQ ID NO: 9595 - DNA, 1492 bp, Synechocystis sp. IPPAS B-1465
  ref <308>: DATABASE ACCESSION NUMBER: NCBI ACCESSION: NZ_CP028094.1
  ref <309>: DATABASE ENTRY DATE: 2019-04-01
  ref <313>: RELEVANT RESIDUES IN SEQ ID NO: (1)..(1492)
aatggagagtttgatcctggctcaggatgaacgctggcggtatgcctaacacatgcaagtcgaacggagttcttcggaacttagtggcggacgggtgagtaacacgtgagaacctaccttcagaatggggacaacagttggaaacgactgctaatacccaatgtgccgaaaggtgaaagatttatcgtctgaagatgggctcgcgtctgattagctagatggtggggtaagagcctaccatggcaacgatcagtagctggtctgagaggatgagcagccacactgggactgagacacggcccagactcctacgggaggcagcagtggggaattttccgcaatgggcgaaagcctgacggagcaataccgcgtgagggaggaaggtccttggattgtaaacctcttttatcagggaagaagttctgacggtacctgatgaataagcatcggctaactccgtgccagcagccgcggtaatacggaggatgcaagcgttatccggaattattgggcgtaaagcgtccgtaggtggttatgcaagtctgccgttaaagaatggagcttaactccataggagcggtggaaactgcaagactagagtacagtaggggtagcaggaattcccagtgtagcggtgaaatgcgtagatattgggaagaacatcggtggcgaaagcgtgctactgggctgaaactgacactgagggacgaaagctagggtagcgaaagggattagatacccctgtagtcctagccgtaaacgatggatactaggcgtggcttgtatcgacccgagccgtgccgaagctaacgcgttaagtatcccgcctggggagtacgcacgcaagtgtgaaactcaaaggaattgacgggggcccgcacaagcggtggagtatgtggtttaattcgatgcaacgcgaagaaccttaccaaggcttgacatccctggaatcctgcggaaacgtgggagtgccttagggagccaggagacaggtggtgcatggctgtcgtcagctcgtgtcgtgagatgttgggttaagtcccgcaacgagcgcaaccctcgtttttagttgccatcattaagttgggcactctagagagactgccggtgacaaaccggaggaaggtggggatgacgtcaagtcatcatgccccttacgccttgggctacacacgtactacaatggtcgggacaacgggcagcgagctcgcgagagtaagcgaatcccatcaaacccggcctcagttcagattgcaggctgcaactcgcctgcatgaaggaggaatcgctagtaatcgcaggtcagaatactgcggtgaattcgttcccgggccttgtacacaccgcccgtcacaccatgggagctggtcacgcccgaagtcgttactctaaccttagggaggagggcgccgaaggcagggctagtgactggggtgaagtcgtaacaaggtagccgtaccggaaggtgtggctggatcacctcctttaaggg

SEQ ID NO: 9596 - DNA, 1494 bp, Synechocystis sp. PCC 6714
  ref <308>: DATABASE ACCESSION NUMBER: NCBI ACCESSION: NZ_CP007542.1
  ref <309>: DATABASE ENTRY DATE: 2019-04-01
  ref <313>: RELEVANT RESIDUES IN SEQ ID NO: (1)..(1494)
aatggagagtttgatcctggctcaggatgaacgctggcggtatgcctaacacatgcaagtcgaacggagttccttcggggacttagtggcggacgggtgagtaacacgtgagaacctaccttcagaatggggacaacagttggaaacgactgctaatacccaatgtgccgagaggtgaaagatttatcgtctgaagatgggctcgcgtctgattagctagatggtggggtaagagcctaccatggcaacgatcagtagctggtctgagaggatgagcagccacactgggactgagacacggcccagactcctacgggaggcagcagtggggaattttccgcaatgggcgaaagcctgacggagcaataccgcgtgagggaggaaggtccttggattgtaaacctcttttatcagggaagaagttctgacggtacctgatgaataagcatcggctaactccgtgccagcagccgcggtaatacggaggatgcaagcgttatccggaattattgggcgtaaagcgtccgtaggtggttatgcaagtctgccgttaaagaatggagcttaactccataggagcggtggaaactgcaagactagagtacagtaggggtagcaggaattcccagtgtagcggtgaaatgcgtagatattgggaagaacatcggtggcgaaagcgtgctactgggctgaaactgacactgagggacgaaagctagggtagcgaaagggattagatacccctgtagtcctagccgtaaacgatggatactaggcgtggcttgtatcgacccgagccgtgccgaagctaacgcgttaagtatcccgcctggggagtacgcacgcaagtgtgaaactcaaaggaattgacgggggcccgcacaagcggtggagtatgtggtttaattcgatgcaacgcgaagaaccttaccaaggcttgacatccctggaatcctgcggaaacgtgggagtgccttagggagccaggagacaggtggtgcatggctgtcgtcagctcgtgtcgtgagatgttgggttaagtcccgcaacgagcgcaaccctcgtttttagttgccatcattaagttgggcactctagagagactgccggtgacaaaccggaggaaggtggggatgacgtcaagtcatcatgccccttacgccttgggctacacacgtactacaatggtcgggacaacgggcagcgagctcgcgagagtaagcgaatcccatcaaacccggcctcagttcagattgcaggctgcaactcgcctgcatgaaggaggaatcgctagtaatcgcaggtcagaatactgcggtgaattcgttcccgggccttgtacacaccgcccgtcacaccatgggagctggtcacgcccgaagtcgttactctaaccgcaagggggagggcgccgaaggcagggctagtgactggggtgaagtcgtaacaaggtagccgtaccggaaggtgtggctggatcacctcctttaaggg

SEQ ID NO: 9597 - DNA, 1492 bp, Synechocystis sp. PCC 6803; identical to SEQ ID NO: 9595
  ref <308>: DATABASE ACCESSION NUMBER: NCBI ACCESSION: NZ_CP012832.1
  ref <309>: DATABASE ENTRY DATE: 2019-04-01
  ref <313>: RELEVANT RESIDUES IN SEQ ID NO: (1)..(1492)

SEQ ID NO: 9598 - DNA, 1495 bp, Synechocystis sp. PCC 7509
  ref <308>: DATABASE ACCESSION NUMBER: NCBI ACCESSION: NZ_ALVU02000001.1
  ref <309>: DATABASE ENTRY DATE: 2019-04-01
  ref <313>: RELEVANT RESIDUES IN SEQ ID NO: (1)..(1495)
aaaacggagagtttgatcctggctcaggatgaacgctggcggtatgcttaacacatgcaagtcgaacggatgttttcggacattagtggcggacgggtgagtaacgcgtgagaatctagcttcaggttggggacaacagttggaaacgactgctaataccgaatgtgccgaaaggtgaaagatttattgcctgaagaagagctcgcgtctgattagctagttggtggggtaaaagcttaccaaggcgacgatcggtagctggtctgagaggacgatcagccacactgggactgagacacggcccagactcctacgggaggcagcagtggggaattttccgcaatgggcgaaagcctgacggagcaataccgcgtgagggaagaaggctcttgggttgtaaacctcttttctgagggaagaaaaaaatgacggtacctcaggaatcagcatcggctaactccgtgccagcagccgcggtaatacggaggatgcaagcgttatccggaatgattgggcgtaaagcgtccgcaggtggcaattcaagtttgcggttaaaggttctggctcaaccagagacaggccgtgaaaactgaatagctagagtatggtaggggcagagggaattcccagtgtagcggtgaaatgcgtagagattgggaagaacaccggtggcgaaagcgctctgctaggccaaaactgacactgagggacgaaagctaggggagcgaatgggattagataccccagtagtcctagccgtaaacgatggatactaggtgtagcttgtatcgacccaagctgtgccgtagctaacgcgttaagtatcccgcctggggagtacgcgcgcaagcgtgaaactcaaaggaattgacgggggcccgcacaagcggtggagtatgtggtttaattcgatgcaacgcgaagaaccttaccaggacttgacatgtcgcgaatcttactgaaaggtaggagtgccttagggagcgcgaacacaggtggtgcatggctgtcgtcagctcgtgtcgtgagatgttgggttaagtcccgcaacgagcgcaaccctcgtttttagttgccatcattaagttgggcactctagagagactgccggtgacaaaccggaggaaggtggggatgacgtcaagtcagcatgccccttacgttctgggctacacacgtactacaatgctacggacaaagggtagcaagcatgcgaatgcaagccaatcccataaaccgtggctcagttcagattgcaggctgcaactcgcctgcatgaaggcggaatcgctagtaatcgcaggtcagcactactgcggtgaatacgttcccgggccttgtacacaccgcccgtcacaccatggaagctggcttagcccgaagtcgttaccctaaccgtaaggagggggatgccgaaggcagggctggtgactggggtgaagtcgtaacaaggtagccgtaccggaaggtgtggctggatcacctcctttaaggg

SEQ ID NO: 9599 - DNA, 1522 bp, Synergistes sp. 3 1 syn1
  ref <308>: DATABASE ACCESSION NUMBER: NCBI ACCESSION: NZ_JH414695.1
  ref <309>: DATABASE ENTRY DATE: 2019-04-01
  ref <313>: RELEVANT RESIDUES IN SEQ ID NO: (1)..(1522)
aaacggagagtttgatcctggctcaggacgaacgctggcggcgtgcctaacacatgcaagtcgaacgaagaccatagaggagcttgctttaatatggttttagtggcggacgggtgagtaacgcgtgaggacttgtcgagtacagggggacaacaggtggaaacgtctgctaataccccataagccttcgggtaaaaggagcgatccggtacacgagagactcgcgttctatcagctagtaggtggggtaacggcccacccaggccaagacggatagccggactgagaggtcgatcggccacactggaactgagacacggtccagactcctacgggaggcagcagtggggaatattgggcaatgggggaaaccctgacccagcgacgccgcgtgagtgaagaaatccctcgggatgtaaaactctgttgtgtgggaagataatgacggtaccacacgaggaagccccggcaaactacgtgccagcagccgcggtaatacgtagggggcgagcgttgttcggaattactgggcgtaaagcgcacgcaggcggaccagtaagtctgtcgtcaaaggcggaggctcaaccttcgttccacgatagatactgcgggtctagagtatgtgagagggaagtggaattcccggtgtagcggtgaaatgcgtagatatcgggaggaacaccagtggcgaaggcggcttcctggcacacaactgacgctcatgtgcgaaagccagggcagcgaacgggattagataccccggtagtcctggccgtaaacgatggatactgggtgtgggtgaagcagttcatccgtgccgtagttaacgcgttaagtatcccgcctggggactacggtcgcaagactgaaactcaaaggaattgacgggggcccgcacaagcggtggagcacgtggtttaattcgatgcaaaccgaagaaccttacctgggtttgacatactactggtactgacctgaaagggaagggaccctagcttgctagggaagtagaacaggtgctgcatggctgtcgtcagctcgtgtcgtgagatgttgggttaagtcccgcaacgagcgcaacccctatagccagttgctaacaagtgaagttgagcactctggcgagactgccgccgacaaggcggaggaaggtggggatgacgtcaagtcatcatggcctttatgcccagggcgacacacgtgctacaatggacggcacaaaaggcagcttactagcgatagttggcgaatcctaaaaagccgttcccagttcggattgcagtctgaaacccgactgcatgaagccggaatcgctagtaatcgcagatcagccaagctgcggtgaatacgttcccgggccttgtacacaccgcccgtcacaccacccgagttgggggcacccgaagccgcaggcttaacccgtaagggaaagaagcgtctaaggtgcgccgagtaaggggggtgaagtcgtaacaaggtagccgtaccggaaggtgcggctggatcacctcctttctaagga

SEQ ID NO: 9600 - DNA, 1541 bp, Syntrophaceticus schinkii
  ref <308>: DATABASE ACCESSION NUMBER: NCBI ACCESSION: NZ_CDRZ01000184.1
  ref <309>: DATABASE ENTRY DATE: 2019-04-01
  ref <313>: RELEVANT RESIDUES IN SEQ ID NO: (1)..(1541)
ttaacggagagtttgatcctggctcaggacgaacgctggcggcgtgcttaacacatgcaagtcgaacggaggatgcggggaagcttgctttcctgcaaacttagtggcggacgggtgagtaacgcgtggataacctgcctgtaagactgggataacactgggaaaccggtgctaataccggatatactgtagagtaggcatctactttacaggaaaagattaacctctgcttacagatggatccgcgtcccattagctagctggtagggtaacggcctaccagggcgacgatgggtagccggcctgagagggtggtcggccacactgggactgagacacggcccagactcctacgggaggcagcagtggggaatcttgcgcaatgggcgaaagcctgacgcagcgacgccgcgtgggtgacgaaggccttcgggtcgtaaaaccctgttgcaggggacgaaggaagtgacggtaccctgccagaaagccccggctaactacgtgccagcagccgcggtaaaacgtagggggcgagcgttgtccggaattactgggcgtaaagggctcgtaggcggtaactcaagtcagttgtgaaaaccgacggcttaaccggaggattgcagttgatactgagttacttgaggcaaggagaggaaggtggaattcccggtgtagcggtgatatgcgtagatatcgggaggaaccccagtggcgaaggcggccttctggtcttgacctgacgctgaggagcgaaagccagggtagcgaacgggattagataccccggtagtcctggctgtaaacgatggacactaggtgtaggtggtatcaaccccatctgtgccgcagctaacgcattaagtgtcccgcctggggagtacggtcgcaaggctgaaactcaaaggaattgacgggggcccgcacaagcggtggagcatgtggtttaattcgatgcaacgcgaagaaccttaccagggcttgacatcctgcgaattctgtggaaacacaggagtgcgcttcggggagcgcagagacaggtggtgcatggttgtcgtcagctcgtgtcgtgagatgttgggttaagtcccgcaacgagcgcaacccttgcccttagttgccatcacgtagaggtgggcactctaaggggactgccggtgacaaaccggaggaaggtggggatgacgtcaaatcatcatgccctttatgtcctgggctacacacgtgctacaatggccggtacagagggtagcgaaggggtgacctgtagccaatcccacaaagccggcccaagttcggattgcaggctgcaattcgcctgcatgaagtcggaatcgctagtaatcgcggatcagaatgccgcggtgaatacgttcccgggccttgtacacaccgcccgtcacaccacgaaagctggcaacacccgaagccggtggcttaaccgcaaggaaagagccgtcgaaggtggggctggtgattggggtgaagtcgtaacaaggtagccgtatcggaaggtgcggctggatcacctcctttctaaggag

SEQ ID NO: 9601 - DNA, 1569 bp, Syntrophobacter fumaroxidans
  ref <308>: DATABASE ACCESSION NUMBER: NCBI ACCESSION: NC_008554.1
  ref <309>: DATABASE ENTRY DATE: 2019-04-01
  ref <313>: RELEVANT RESIDUES IN SEQ ID NO: (1)..(1569)
aaactggagagtttgatcctggctcagaataaacgctggcggcgtgcctaacacatgcaagtcgaacgagaaagccttaatcttcggatgggcgagtaaagtggcgcacgggtgagtaacgcgtaggtaacctacctccgggaccgggataacagtgcgaaagtgctgctaataccggatacgattgtggagcgggagctctacgatgaaagtcggcctctcagagaagccgatgttcggggatgggcctgcgtcctatcagctggttggtagggtaacggcctaccaaggcgacgacgggtagctggtctgagaggatgatcagccacactggcactggaacacgggccagactcctacgggaggcagcagtgaggaattttgcgcaatggccgcaaggctgacgcagcaacgccgcgtgggtgaagaaggccttcgggtcgtaaagccctgtcaggtgggaagaacaccatggggacgaataagcttcatggctgacggtaccaccagaggaagcaccggctaactccgtgccagcagccgcggtaatacggagggtgcgagcgttattcggaattactgggcgtaaagcgcgtgcaggcggtttggcaagtctgatgtgaaagccccgggcttaacctgggaagtgcattggaaactgccggacttgagtactggagaggaagggggaattcccggtgtagaggtgaaattcgtagagatcgggaggaataccagtggcgaaggcgcccttctggacggttactgacgctgagacgcgaaagcgtggggagcaaacaggattagataccctggtagtccacgctgtaaacgatgagcactaggtgtagcgggtactcattcctgctgtgccgcagctaacgcgttaagtgctccgcctggggattacggtcgcaagactaaaactcaaaggaattgacgggggcccgcacaagcggtggagtatgtggtttaattcgacgcaacgcgaagaaccttacctgggcttgacatccccggacggccctggaaacagggatttccccttcgggggaccgggagacaggtgctgcatggctgtcgtcagctcgtgtcgtgagatgttgggttaagtcccgcaacgagcgcaacccttgcctttagttgccatcattgagttgggcactctaaagggactgccggtgtgaaaccggaggaaggtggggatgacgtcaagtcctcatggcctttatgcccagggctacacacgtactacaatgggcggtacaaagggaagcgagcccgcgagggggagccaaccccaaaaagccgttcacagttcggatcggagtctgcaactcgactccgtgaagttggaatcgctagtaatcgcggatcagcatgccgcggtgaatacgttcccgggccttgtacacaccgcccgtcacaccacgaaagtcggctgtaccagaagtgcgtgggctaacttttcggagaggcagcgtaccaaggtgtggtcggtaattggggtgaagtcgtaacaaggtagccgtaggggaacctgcggctggatcacctcctttctaagga

SEQ ID NO: 9602 - DNA, 1576 bp, Syntrophobotulus glycolicus
  ref <308>: DATABASE ACCESSION NUMBER: NCBI ACCESSION: NC_015172.1
  ref <309>: DATABASE ENTRY DATE: 2019-04-01
  ref <313>: RELEVANT RESIDUES IN SEQ ID NO: (1)..(1576)
ttttatggagagtttgatcctggctcaggacgaacgctggcggcgtgcctaacacatgcaagtcgaacggagaatattgaggaagcttgcgaattgatattcttagtggcgaacgggtgagtaacgcgtgggtaacctgtcctcatgaccggaataacagttggaaacgactgctaatgccggataagcttttggtaaggcatcttaccggaaggaaagctggcctctgaatatgctagtgcaagagggtggacccgcgtctgattagctggttggtagagtaaaagcctaccaaggcgacgatcagtagccggcctgagagggtaaacggccacactgggactgagacacggcccagactcctacgggaggcagcagtggggaatcttccgcaatggacgaaagtctgacggagcaacgccgcgtgtatgaagaaggctttcgggttgtaaagtactgttgtcagggacgaaccgtatatgtgtaaataatgcatatacctgacggtacctgacgaggaagccccggctaactacgtgccagcagccgcggtaatacgtagggggcgagcgttgtccggaattattgggcgtaaagggcgcgtaggcggctgtataagtctgatgtgaaagtgcggagcttaactccgtaaagcattggaaactgtacggcttgaggacaggagaggaaagtggaattccacgtgtagcggtgaaatgcgtagatatgtggaggaacaccagtggcgaaggcgactttctggactgtaactgacgctgaggcgcgaaagcgtggggagcgaacaggattagataccctggtagtccacgccgtaaacgatgagtgctaggtgtagagggtatcgaccccttctgtgccgcagttaacacaataagcactccgcctggggagtacggccgcaaggttgaaactcaaaggaattgacgggggcccgcacaagcggtggagcatgtggtttaattcgacgcaacgcgaagaaccttaccaaggcttgacatctacagaatcccgaagagattcgggagtgcctttcggggaactgtaagacaggtggtgcatggttgtcgtcagctcgtgtcgtgagatgttgggttaagtcccgcaacgagcgcaacccctatatttagttactaacaggtaaagctgaggactctagatagactgccggtgacaaaccggaggaaggtggggatgacgtcaaatcatcatgccccttatgtcttgggctacacacgtgctacaatgggcggtacagacggaagcgaagccgagaggtggagcaaatccgagaaagccgttcgtagttcggattgatctctgcaactcgagatcatgaagtcggaatcgctagtaatcgcaggtcagcacactgcggtgaatacgttcccgggccttgtacacaccgcccgtcacaccacgaaagtttgcaacacccgaagccggtgaggtaacctaagggagccagccgtcgaaggtggggcagatgattggggtgaagtcgtaacaaggtagccgtatcggaaggtgcggctggatcacctcctttctagggaga

SEQ ID NO: 9603 - DNA, 1470 bp, Syntrophomonas palmitatica
  ref <308>: DATABASE ACCESSION NUMBER: NCBI ACCESSION: NZ_BBCE01000045.1
  ref <309>: DATABASE ENTRY DATE: 2019-04-01
  ref <313>: RELEVANT RESIDUES IN SEQ ID NO: (1)..(1470)
agtggcggacgggtgagtaacgcgtgggcaacctacccataagagggggataacagttggaaacgactgctaataccgcataagctaacgagagcgcatgttcatgttagtaaagatggcctctgaaaatgctatcgcttatggatgggcccgcgtctgattagctagttggtggggtaacggcctaccaaggcgacgatcagtagccggcctgagagggtggacggccacactgggactgagacacggcccagactcctacgggaggcagcagtggggaatattgcgcaatgggggaaaccctgacgcagcgacgccgcgtgagcgaagaaggccttagggttgtaaagctctgttttaagggacgaatgtctagagcaataacacggctttagaatgacggtaccttaagaggaagccccggctaactacgtgccagcagccgcggtaagacgtagggggcgagcgttgtccggaattactgggcgtaaagagcacgtaggcgggactttaagtcaggtgtgaaataccggggcctaaccccggggctgcacctgaaactggagttcttgagggcaggagagggcagtagaattcctggtgtagcggtgaaatgcgtagaaatcaggaggaataccagtggcgaaggcgactgtctggactgaccctgacgctgaggtgcgaaagcgtgggtagcaaacaggattagataccctggtagtccacgctgtaaacgatggatactaggtgtgggaggtatcgaccccttccgtgccggagcaaacgcaataagtatcccgcctggggagtacggtcgcaaggctgaaactcaaaggaattgacgggggcccgcacaagcggtggagcatgtggtttaattcgatgcaacgcgaagaaccttaccaggtcttgacatccaaagaatcctgatgaaagtcgggagtgccttcgggagctttgagacaggtggtgcatggttgtcgtcagctcgtgtcgtgagatgttgggttaagtcccgcaacgagcgcaacccttgctattagttgctaacaggcaaagctgagcactctaatgggactgcccgtgacaagcgggaggaaggtggggatgacgtcaaatcatcatgccctttatgatctgggctacacacgtgctacaatggacggtacagagagcagcgataccgtgaggtggagcgaatctcaaaaagccgttctcagttcggattgcaggctgcaactcgcctgcatgaagtcggaatcgctagtaatcgcgaatcagcacgtcgcggtgaatccgttcccgggccttgtacacaccgcccgtcacaccacgaaagtcggcaacacccgaagccggtgactcaactttaatagagagagccgtccaaggtgggttggtaattggggtgaagtcgtaacaaggtatccgtaccggaaggtgcggatggatcacctcctttctaaggag

SEQ ID NO: 9604 - DNA, 1237 bp, Syntrophomonas wolfei
  ref <308>: DATABASE ACCESSION NUMBER: NCBI ACCESSION: NZ_BBQT01000054.1
  ref <309>: DATABASE ENTRY DATE: 2019-04-01
  ref <313>: RELEVANT RESIDUES IN SEQ ID NO: (1)..(1237)
acaaagctatcacttatggatgggcccgcgtctgattagctagttggcagggtagcggcctaccaaggcaacgatcagtagccggcctgagagggtggacggccacactgggactgagacacggcccagactcctacgggaggcagcagtggggaatattgcgcaataggggaaaccctgacgcagcgacgccgcgtgagcgaagaaggccttagggttgtaaagctctgttgtaagggaagaagaacttaagcgaaaatattgtttaagagtgacggtaccttagcagaaagccccggctaactacgtgccagcagccgcggtaagacgtagggggcgagcgttgtccggaattactgggcgtaaagagcacgtaggcggatatttaagtcagatgtgaaagaccgcagctcaactgcggggttgcatttgaaactaggtatcttgagggcaggagagggcagtggaattcctggtgtagcggtgaaatgcgtagaaatcaggaggaacaccagtggcgaaggcgactgtctggactgaccctgacgctgaggtgcgaaagcgtgggtagcaaacaggattagataccctggtagtccacgccgtaaacgatggatactaggtgtaggaggtatcgaccccttctgtgccgcagctaacgcaataagtatcccgcctggggagtacggtcgcaaggctgaaactcaaaggaattgacgggggcccgcacaagcggtggagcatgtggtttaattcgatgcaacgcgaagaaccttaccaggtcttgacatcctacggatttctatgaaaataggaagtgccttttaggagcgtagagacaggtggtgcatggttgtcgtcagctcgtgtcgtgagatgttgggttaagtcccgcaacgagcgcaacccctgctattagttgctaacatttaggatgagcactctaatgggactgcctgtgacaagcaggaggaaggtggggatgacgtcaaatcatcatgccctttatgatctgggctacacacgtgctacaatggatggtacagagggccgcgaagccgtgaggtgaagcgaatctcaaaaagccattctcagttcggattgcagtctgcaactcgactgcatgaagtcggaatcgctagtaatcgcgaatcagcacgtcgcggtgaatgcgttcccgggccttgtacacaccgcccgtcacaccacgaaagtcggcaacacccgaagccggtga

SEQ ID NO: 9605 - DNA, 1722 bp, Syntrophomonas zehnderi
  ref <308>: DATABASE ACCESSION NUMBER: NCBI ACCESSION: NZ_CGIH01000026.1
  ref <309>: DATABASE ENTRY DATE: 2019-04-01
  ref <313>: RELEVANT RESIDUES IN SEQ ID NO: (1)..(1722)
ttttattggagagtttgatcctggctcaggacgaacgctggcggcgtgcctaacacatgcaagtcgaacggactaatgtttgacactgagtgttttaagaaggatcaagaagagtcaagacccgaagcgggggagaacattcagagttgaacattagttagtggcggacgggtgagtaacgcgtgggtaatctgcctaagagtggggaataacagttggaaacgactgctaataccgcataaactgctaacgcagcaaagatggcctcttaacaatgctgtcgcttttagatgagcccgcgtctgattagctagttggtggggtaaaggcctaccaaggcaacgatcagtagccggcctgagagggtgaacggccacactgggactgagacacggcccagactcctacgggaggcagcagtggggaatattgcgcaatgggggaaaccctgacgcagcgacgccgcgtgagcgaagaaggccttagggttgtaaagctctgttttaagggacgaatgttcgcgtcagtaatatgggcgtgaaatgacggtaccttaagaggaagccccggctaactacgtgccagcagccgcggtaagacgtagggggcgagcgttgtccggaattactgggcgtaaagagcacgtaggcgggactttaagtcaggtgtgaaagaccggggctcaacctcggggttgcacttgaaactggagttcttgagggcaggagaggaaagcagaattcctggtgtagcggtgaaatgcgtagaaatcaggaggaataccagtggcgaaggcggctttctggactgaccctgacgctgaggtgcgaaagcgtgggtagcaaacaggattagataccctggtagtccacgccgtaaacgatggatactaggtgtaggaggtatcgaccccttctgtgccgcagctaacgcaataagtatcccgcctggggagtacggtcgcaaggctgaaactcaaaggaattgacgggggcccgcacaagcggtggagcatgtggtttaattcgatgcaacgcgaagaaccttaccaggtcttgacatctggcgaatcctgtagaaatacgggagtgccttttaggagcgccaagacaggtggtgcatggttgtcgtcagctcgtgtcgtgagatgttgggttaagtcccgcaacgagcgcaacccctgctattagttgctaacattaagctgagcactctaatgggactgcctgtgacaagcaggaggaaggtggggacgacgtcaaatcatcatgccctttatgatctgggctacacacgtgctacaatgggtggtacagagagcagcgagaccgtgaggtggagcgaatctcaaaaagccattctcagttcggattgaagtctgcaactcgacttcatgaagtcggaatcgctagtaatcgcgaatcagcatgtcgcggtgaatgcgttcccgggccttgtacacaccgcccgtcacaccacgaaagtcggcaacacccgaagccagtgagctaactgaacggaagtcagaggtcagaagtaagaagtcagagattagtgaagaaattggcaatgccaatttcaaccaaagatccgacctcctacatccgatttccgacttctgttcagaggcagctgtcgaaggtggggttggtgattggggtgaagtcgtaacaaggtatccgtaccggaaggtgcggatggatcacctcctttctaaggaga

SEQ ID NO: 9606 - DNA, 1564 bp, Syntrophorhabdus aromaticivorans
  ref <308>: DATABASE ACCESSION NUMBER: NCBI ACCESSION: NZ_KI867150.1
  ref <309>: DATABASE ENTRY DATE: 2019-04-01
  ref <313>: RELEVANT RESIDUES IN SEQ ID NO: (1)..(1564)
ttgatctgagagtttgatcctggctcagaacgaacgctggcggcgtgcctaacacatgcaagtcgagcgagaaagtcccttcgggggcgagtagagcggcggacgggtgagtaatacgtgggtaatctaccctcgagcctggaataactccgcgaaagcggggctaataccggataagaccacacgacacatgtcgcggggtagaaggtggcttgtattcgtacatgctatcacttgaggatgagcccatggcctatcagcttgttggtgaggtaagagcttaccaaggctatgacgggtagctggtctgagaggacgactagccacactgggactgagacacggcccagactcctacgggaggcagcagtggggaatattgggcaatgggcgaaagcctgacccagcgacgccgcgtgggcgatgaaggccttcgggttgtaaagccctttcgtgcggaaagaatagtcccgtggtgaatatccgcgggatttgacggtaccgcaggaagaagcaccggctaactccgtgccagcagccgcggtaatacggagggtgcaagcgttgttcggaattattgggcgtaaagggcgcgtaggcggttgtgatagtcagatgtgaaatcctccggcttaactggagaactgcatctgaaacttcatagctagagtacaggagagggaaacggaattcccggtgtagaggtgaaattcgtagatatcgggaggaacaccagtggcgaaggcggtttcctggcctgatactgacgctgaggcgcgaaagcgtggggagcaaacaggattagataccctggtagtccacgcggtaaacggtgaacactaggtgtgggaggtgtaataccttctgtgccgaagctaacgcgttaagtgttccgcctgggaagtacggccgcaaggttgaaactcaaaggaattgacgggggcccgcacaagcggtggagcatgtggtttaattcgacgcaacgcgaaaaaccttacctgggcttgacatgccgagaacccggtggaaacatcggggtgccccgtaaggggaacttggacacaggtgctgcatggctgtcgtcagctcgtgccgtgaggtgttgggttaagtcccgcaacgagcgcaaccctcatccttagttgccatcattaagttgggcaccctaaggaaactgccgcagttaatgcggaggaaggtggggatgacgtcaagtcctcatggcccttatacccagggctacacacgtgctacaatggacggtacaaagggtcgcgaacctgcgagggggagctaatcccacaaaaccgttctcagttcggattggagtctgcaacccgactccatgaagctggaatcgctagtaatcgcggatcagcatgccgcggtgaatacgttcccgggccttgtacacaccgcccgtcacaccacgaaagcttgttgtaccagaagtcgttgggctaactcgcaagagaggcagacgccgaaggtatggcaggtaattggggtgaagtcgtaacaaggtagccgtaggggaacctgcggctggatcacctcctttcta

SEQ ID NO: 9607 - DNA, 1739 bp, Syntrophothermus lipocalidus
  ref <308>: DATABASE ACCESSION NUMBER: NCBI ACCESSION: NC_014220.1
  ref <309>: DATABASE ENTRY DATE: 2019-04-01
  ref <313>: RELEVANT RESIDUES IN SEQ ID NO: (1)..(1739)
atggagagtttgatcctggctcaggacgaacgctggcggcgtgcctaacacatgcaagtcgagcggtccggcactcagcacagtgctcattcgggggatgtaggaagtagagggagaggcaattggagcaggtaattaggggatgagtgagcagtgagctgagtgccggatagcggcggacgggtgagtaacgcgtgggtaatctacccataagagggggataacactgggaaaccggtgctaataccgcataagctattcggtatgcatgtactggatagtaaaggtggcctctggagcaagctaccgcttatggatgagcccgcgtctgattagctagttggtggggtaacggcctaccaaggcgacgatcagtagccggcctgagagggtggacggccacactgggactgagacacggcccagactcctacgggaggcagcagtggggaatattgcgcaatggggggaaccctgacgcagcgacgccgcgtgagcgacgaaggccttcgggttgtaaagctcttttattagggacgaaatcccgcatgcgaatagtgtgtggggatgacggtacctaatgaataagccccggctaactacgtgccagcagccgcggtaagacgtagggggcgagcgttgtccggaattactgggcgtaaagagcgtgtaggcgggctgttaagtcaggtgtgaaataccgcagctcaactgcggggtggcatctgatactggcagtcttgagggcaggagagggaagtggaattcctggtgtagcggtgaaatgcgtagatatcaggaggaacaccagtggcgaaggcggcttcctggactggccctgacgctgagacgcgaaagcgtggggagcaaacaggattagataccctggtagtccacgctgtaaacgatgggcactaggtgtaggaggtatcgaccccttctgtgccgcagctaacgcaataagtgccccgcctggggagtacggtcgcaaggctgaaactcaaaggaattgacgggggcccgcacaagcggtggagcatgtggtttaattcgatgcaacgcgaagaaccttaccagggcttgacatcctgcggacctggtggaaacactggggtgccttagggaaacttaaggaacgcagagacaggtggtgcatggttgtcgtcagctcgtgtcgtgagatgttgggttaagtcccgcaacgagcgcaacccttgctgttagttgctaacgggtgaagccgagcactctaacgggactgccggtgacaagccggaggaaggtggggatgacgtcaaatcatcatgccctttatgccctgggctacacacgtgctacaatggccggtacagagagaagcgaagccgcgaggtggagcaaatctcaaaagccggtctcagttcggattgcaggctgcaactcgcctgcatgaagtcggaatcgctagtaatcgcgaatcagaacgtcgcggtgaatgcgttcccgggccttgtacacaccgcccgtcacaccacgaaagctggcaacacccgaagccggtgagccaacccggcactcaagtggtgggaaaagactttaggagatggttgctgaaggaaagcaggaagcatcttcggagcgagttctcgccagttgagtgccgggaggcagccgtcgaaggtggggctggtgattggggtgaagtcgtaacaaggtatccgtaccggaaggtgcggatggatcacctcctttctaaggag

SEQ ID NO: 9608 - DNA, 1566 bp, Syntrophus aciditrophicus
  ref <308>: DATABASE ACCESSION NUMBER: NCBI ACCESSION: NC_007759.1
  ref <309>: DATABASE ENTRY DATE: 2019-04-01
  ref <313>: RELEVANT RESIDUES IN SEQ ID NO: (1)..(1566)
aaactggagagtttgatcctggctcagaacgaacgctggcggcgtgcctaacacatgcaagtcgtacgagaaaatccgtttcggcggatgagtaaagtggcgcacgggtgagtaacgcgtggataatctgcctttaagctgggaataactcatcgaaaggtgggctaatacccgataatgctatgcagctaaggttgtatagtcaaagagagcctctgcttgcaagccctcacttagagatgagtccgcgtaccattagctagttggtagggtaatggcctaccaaggcgatgatggttagctggtctgagaggatgatcagccacactggaactgagacacggtccagactcctacgggaggcagcagtgaggaatattgcgcaatgggggaaaccctgacgcagcaacgccgcgtgagtgaggaaggttttcggatcgtaaagctctgtcgggtgggaagaaatgtatggaggttaatagcctttgtacttgacggtaccgccaaaggaagcaccggctaactccgtgccagcagccgcggtaatacggggggtgcaagcgttgttcggaatcattgggcgtaaagagcgtgtaggcggctgagcaagtcagatgtgaaatccctgggcttaacccaggaagtgcatttgaaactgttcagcttgagtaaggaagagggaagtggaattcctggtgtagaggtgaaattcgtagatatcaggaggaacaccggtggcgaaggcgacttcctggtcctatactgacgctgagacgcgagagcgtggggagcaaacaggattagataccctggtagtccacgccgtaaacgatgttcactaggtgttgagggtattgaccccttcagtgccgaagctaacgcattaagtgaaccgcctggggagtacggtcgcaagattaaaactcaaaggaattgacgggggcccgcacaagcggtggagcatgtggtttaattcgatgcaacgcgaagaaccttacctgggcttgacatcccgggaatcttctggaaacaggagagtgcccttcggggaacccggagacaggtgctgcatggctgtcgtcagctcgtgtcgtgagatgttgggttaagtcccgcaacgagcgcaacccttgtctttaattgccatcattcagttgggcactttaaagagactgccggcgttaaaccggaggaaggtggggatgacgtcaagtcctcatggcctttatgcccagggctacacacgtgctacaatgggtggtacaaagagcagccaactcgcgagagtgagcaaatctcaaaaagccatcctcagttcggattggagtctgcaactcgactccatgaagtcggaatcgctagtaatcgcggatcagcatgccgcggtgaatacgttcccgggccttgtacacaccgcccgtcacacccggaaaattgattgcaccagaagtcgttgagctaacccctattttagaggaggcaggcgcctacggtgtggttggtaatcggggtgaagtcgtaacaaggtagccgtaggggaacctgtggctggatcacctcctttct

SEQ ID NO: 9609 - DNA, 1471 bp, Tabrizicola aquatica
  ref <308>: DATABASE ACCESSION NUMBER: NCBI ACCESSION: NZ_PJON01000009.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgaacgggatcttcggatctagtggcggacgggtgagtaacgcgtgggaacgtaccctttggttcggaatagccctgggaaactgggagtaataccggatacggtcgagagacgaaagatttatcgccgaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagtggggaagataatgacggtacccacagaagaagccccggctaactccgtgccagcagccgcggtaatacggagggggctagcgttgttcggaattactgggcgtaaagcgcacgtaggcggaccggaaagtcagaggtgaaatcccagggctcaaccttggaactgcctttgaaactcctggtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggtagcatgctattcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatgggtatcgcgggaccagagatggtcctttcagttcggctggataccacacaggtgctgcatggctgtcgtcagctcgtgtcgtgagatgttcggttaagtccggcaacgagcgcaacccacacttccagttgccatcattcagttgggcactctggaagaactgccggtgataagccggaggaaggtgtggatgacgtcaagtcctcatggcccttacgggttgggctacacacgtgctacaatggtggtgacaatgggttaatcccaaaaagccatctcagttcggattggggtctgcaactcgaccccatgaagtcggaatcgctagtaatcgcgtaacagcatgacgcggtgaatacgttcccgggccttgtacacaccgcccgtcacaccatgggaattgggtctacccgacgacggtgcgccaacctcgcaagaggaagcagccggccacggtaggctcagtgactggggtgaagtcgtaacaaggtagccgtaggggaacctgcggctggatcacctcctttctaa

SEQ ID NO: 9610 - DNA, 1470 bp, Tabrizicola sp. DJC
  ref <308>: DATABASE ACCESSION NUMBER: NCBI ACCESSION: NZ_QWEY01000026.1
  ref <309>: DATABASE ENTRY DATE: 2019-04-01
  ref <313>: RELEVANT RESIDUES IN SEQ ID NO: (1)..(1470)
caacttgagagtttgatcctggctcagaatgaacgctggcggcaggcctaacacatgcaagtcgaacgaagccttcgggtttagtggcggacgggtgagtaacgcgtgggaacgtgccctttggttcggaatagccctgggaaactgggagtaataccgaatgtgcccttcgggggaaagatttatcgccaaaggatcggcccgcgttggattaggtagttggtgaggtaatggctcaccaagccgacgatccatagctggtttgagaggatgatcagccacactgggactgagacacggcccagactcctacgggaggcagcagtggggaatcttagacaatgggggaaaccctgatctagccatgccgcgtgatcgatgaaggccttagggttgtaaagatctttcagatgggaagataatgacggtaccatcagaagaagccccggctaactccgtgccagcagccgcggtaatacggagggggctagcgttattcggaattactgggcgtaaagcgcacgtaggcggactggaaagtcagaggtgaaatcccagggctcaaccttggaactgcctttgaaactcccagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatgggtatcgcggatccagagatggatctttcagttcggctggataccacacaggtgctgcatggctgtcgtcagctcgtgtcgtgagatgttcggttaagtccggcaacgagcgcaacccacactcttagttgccatcattcagttgggcactctaggagaactgccggtgataagccggaggaaggtgtggatgacgtcaagtcctcatggcccttacgggttgggctacacacgtgctacaatggtggtgacaatgggttaatcccaaaaagccatctcagttcggattggggtctgcaactcgaccccatgaagtcggaatcgctagtaatcgcgtaacagcatgacgcggtgaatacgttcccgggccttgtacacaccgcccgtcacaccatgggaattgggtctacccgacgacggtgcgccaacctcgcaagaggaagcagccggccacggtaggctcagtgactggggtgaagtcgtaacaaggtagccgtaggggaacctgcggctggatcacctcctttcta

SEQ ID NO: 9611 - DNA, 1471 bp, Tabrizicola sp. K13M18
  ref <308>: DATABASE ACCESSION NUMBER: NCBI ACCESSION: NZ_CP034328.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgaacggacccttcggggttagtggcggacgggtgagtaacgcgtgggaacgtgcccctttcttcggaatagcctcgggaaactgggagtaataccggataagccctacgggggaaagatttatcgggaagggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgatcgatgaaggccttagggttgtaaagatctttcagtggggaagataatgacggtacccacagaagaagccccggctaactccgtgccagcagccgcggtaatacggagggggctagcgttgttcggaattactgggcgtaaagcgcacgtaggcggaccggaaagtcagaggtgaaatcccagggctcaaccttggaactgcctttgaaactcctggtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatgggtatcgcgggaccggagacggtcctttcagttcggctggataccacacaggtgctgcatggctgtcgtcagctcgtgtcgtgagatgttcggttaagtccggcaacgagcgcaacccacactcttagttgccatcattcagttgggcactctaggagaactgccggtgataagccggaggaaggtgtggatgacgtcaagtcctcatggcccttacgggttgggctacacacgtgctacaatggtggtgacaatgggtgaatcccaaaaagccatctcagttcggattggggtctgcaactcgaccccatgaagtcggaatcgctagtaatcgcgtaacagcatgacgcggtgaatacgttcccgggccttgtacacaccgcccgtcacaccatgggaattgggtctacccgacgacggtgcgccaacctcgcaagaggaagcagccggccacggtaggctcagtgactggggtgaagtcgtaacaaggtagccgtaggggaacctgcggctggatcacctcctttctaa

SEQ ID NO: 9612 - DNA, 1468 bp, Tabrizicola sp. TH137
  ref <308>: DATABASE ACCESSION NUMBER: NCBI ACCESSION: NZ_PKRQ01000028.1
  ref <309>: DATABASE ENTRY DATE: 2019-04-01
  ref <313>: RELEVANT RESIDUES IN SEQ ID NO: (1)..(1468)
caacttgagagtttgatcctggctcagaacgaacgctggcggcaggcctaacacatgcaagtcgagcgaggttttcggacctagcggcggacgggtgagtaacgcgtgggaacgtgccccttggtacggaatagccccgggaaactgggagtaataccgtatgagctctacggaggaaagatttatcgccaagggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggcgcaagcctgatctagccatgccgcgtgagcgatgaaggccttagggttgtaaagctctttcagcgaggaagataatgactgtactcgcagaagaagccccggctaactccgtgccagcagccgcggtaatacggagggggctagcgttgttcggaattactgggcgtaaagcgcacgtaggcggactggaaagtcaggggtgaaatcccggggctcaaccccggaactgcctttgaaactcccagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcggcaggcatgcctgtcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatgggtatcgcggcctcagagatggggctttcagttcggctggataccacacaggtgctgcatggctgtcgtcagctcgtgtcgtgagatgttcggttaagtccggcaacgagcgcaacccacactcttagttgccatcattcagttgggcactctaggagaactgccggtgataagccggaggaaggtgtggatgacgtcaagtcctcatggcccttacgggttgggctacacacgtgctacaatggtggtgacaatgggataatccccaaaagccatctcagttcggattggggtctgcaactcgaccccatgaagtcggaatcgctagtaatcgcgtaacagcatgacgcggtgaatacgttcccgggccttgtacacaccgcccgtcacaccatgggaattgggtctacccgaaggcggtgcgccaaccagcaatggaggcagccgaccacggtaggctcagtgactggggtgaagtcgtaacaaggtagccgtaggggaacctgcggctggatcacctcctttcta

SEQ ID NO: 9613 - DNA, 1471 bp, Tabrizicola sp. XJSP
  ref <308>: DATABASE ACCESSION NUMBER: NCBI ACCESSION: NZ_PJOM01000011.1
  ref <309>: DATABASE ENTRY DATE: 2019-04-01
  ref <313>: RELEVANT RESIDUES IN SEQ ID NO: (1)..(1471)
caacttgagagtttgatcctggctcagaatgaacgctggcggcaggcctaacacatgcaagtcgaacgaagccttcgggtttagtggcggacgggtgagtaacgcgtgggaacgtgccctttggttcggaatagccctgggaaactgggagtaataccgaatgtgcccttcgggggaaagatttatcgccaaaggatcggcccgcgttggattaggtagttggtgaggtaatggctcaccaagccgacgatccatagctggtttgagaggatgatcagccacactgggactgagacacggcccagactcctacgggaggcagcagtggggaatcttagacaatgggggaaaccctgatctagccatgccgcgtgatcgatgaaggccttagggttgtaaagatctttcagatgggaagataatgacggtaccatcagaagaagccccggctaactccgtgccagcagccgcggtaatacggagggggctagcgttattcggaattactgggcgtaaagcgcacgtaggcggactggaaagtcagaggtgaaatcccagggctcaaccttggaactgcctttgaaactcccagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatgggtatcgcggatccagagatggatctttcagttcggctggataccacacaggtgctgcatggctgtcgtcagctcgtgtcgtgagatgttcggttaagtccggcaacgagcgcaacccacactcttagttgccatcattcagttgggcactctaggagaactgccggtgataagccggaggaaggtgtggatgacgtcaagtcctcatggcccttacgggttgggctacacacgtgctacaatggtggtgacaatgggttaatcccaaaaagccatctcagttcggattggggtctgcaactcgaccccatgaagtcggaatcgctagtaatcgcgtaacagcatgacgcggtgaatacgttcccgggccttgtacacaccgcccgtcacaccatgggaattgggtctacccgacgacggtgcgccaacctcgcaagaggaagcagccggccacggtaggctcagtgactggggtgaagtcgtaacaaggtagccgtaggggaacctgcggctggatcacctcctttctaa

SEQ ID NO: 9614 - DNA, 1520 bp, Taibaiella sp. KBW10
  ref <308>: DATABASE ACCESSION NUMBER: NCBI ACCESSION: NZ_QAJI01000011.1
  ref <309>: DATABASE ENTRY DATE: 2019-04-01
  ref <313>: RELEVANT RESIDUES IN SEQ ID NO: (1)..(1520)
acaaaggagagtttgatcctggctcaggatgaacgctagcggcaggcttaacacatgcaagtcgaggggtatatggtacttgtatcatagagaccggcaaacgggtgcggaacacgtacacaacctacctttatctgggagatagcccaaagaaatttggattaataccccatagtataacagaatggcatcatttagttattaaagaacttcggatagagatgggtgtgcgtaagattagctagttggtaaggtaacggcttaccaaggcgacgatctttagctgatgtgagagcatgatcagccacacgggcactgagacacgggcccgactcctacgggaggcagcagtgaggaatattggtcaatggacgaaagtctgaaccagccatgccgcgtgaaggatgaaggcgttctgcgttgtaaacttcttttattggggaagaaatcactgttttctaacagtgttgacggtatccaatgaataagcaccggctaactccgtgccagcagccgcggtaatacggagggtgcaagcgttatccggatttactgggtttaaagggtgtgtaggcggacttttaagtcaggggtgaaatctccgagctcaactcggaaactgcctttgatactattagtcttgaattatgttgaggttggcggaatataacatgtagcggtgaaatgcatagatatgttatagaacaccgattgcgaaggcagctggctaaacatatattgacgctgaggcacgaaagcgtgggtagcgaacaggattagataccctggtagtccacgccctaaacgatgattactcgtcatttgtgatacacaataagtgaccaagcgaaagcgttaagtaatccacctgggaagtacgaccgcaaggttgaaactcaaaggaattgacgggggtccgcacaagcggtggagcatgtggtttaattcgatgatacgcgaggaaccttacctgggctagaatgtgatcgaccgatggtgaaagccatttttccgcaaggacgagaaacaaggtgctgcatggctgtcgtcagctcgtgccgtgaggtgttgggttaagtcccgcaacgagcgcaacccccatcttcagttgccatcattaagttgggaactctgaagaaactgccgccgtaaggcgagaggaaggaggggacgatgtcaagtcatcatggcctttatgcccagggctacacacgtgctacaatggtaaggacaaagggttgctacctagcgataggatgctaatctcaaaaaccttatctcagttcggattgcaggctgcaactcgcctgcatgaagctggaatcgctagtaatcgcgcatcagcaatggcgcggtgaatacgttcccggaccttgtacacaccgcccgtcaagccatggaagtcgggtgtacctaaagtcggtaaccgcaaggagccgcctagggtaaaatcgataactggggctaagtcgtaacaaggtagccgtaccggaaggtgcggctggaatacctccttttta

SEQ ID NO: 9615 - DNA, 1543 bp, Tamilnaduibacter salinus
  ref <308>: DATABASE ACCESSION NUMBER: NCBI ACCESSION: NZ_QEKQ01000016.1
  ref <309>: DATABASE ENTRY DATE: 2019-04-01
  ref <313>: RELEVANT RESIDUES IN SEQ ID NO: (1)..(1543)
aaactgaagagtttgatcatggctcagattgaacgctggcggcaggcctaacacatgcaagtcgagcggaaacgatgggagcttgctcccaggcgtcgagcggcggacgggtgagtaatgcataggaatctgcccggtagtgggggatagcccggggaaacccggattaataccgcatacgccctttgggggaaagcaggggatcttcggaccttgcgctatcggatgagcctatgtcggattagttagttggtggggtaatggcctaccaaggcgacgatccgtagctggtctgagaggatgatcagccacatcgggactgagacacggcccgaactcctacgggaggcagcagtggggaatattggacaatgggggcaaccctgatccagccatgccgcgtgtgtgaagaaggctttcgggttgtaaagcactttcagcagggaggaaagcttgtcggttaatacccggcaagggcgacgttacctgcagaagaagcaccggctaactccgtgccagcagccgcggtaatacggagggtgcaagcgttaatcggaattactgggcgtaaagcgcgcgtaggcggttggataagcgagatgtgaaagccctgggcttaacctgggaatggcatttcgaactgtctggctagagtgtggtagagggtagtggaatttccagtgtagcggtgaaatgcgtagatattggaaagaacaccagtggcgaaggcggctacctggaccaacactgacgctgaggcgcgaaagcgtggggagcaaacaggattagataccctggtagtccacgccgtaaacgctgtcgaccagccgttggggatgttagatccttagtggcgcagttaacgcactaagtcgaccgcctggggagtacggccgcaaggttaaaactcaaatgaattgacgggggcccgcacaagcggtggagcatgtggtttaattcgacgcaacgcgaagaaccttacctggccttgacatcctgcgaacttggtagagataccttggtgccttcgggagcgcagtgacaggtgctgcatggccgtcgtcagctcgtgtcgtgagatgttgggttaagtcccgtaacgagcgcaacccttatccttagttgccagcggtccggccgggaactctagggagactgccggtgacaaaccggaggaaggtggggatgacgtcaggtcatcatggcccttacggccagggctacacacgtgctacaatggtgcgtacaacaggctgctaacccgcgagggggcgccaatcctgcaaagcgcatcgtagtccggatcggagtctgcaactcgactccgtgaagtcggaatcgctagtaatcgcagatcagaatgctgcggtgaatacgttcccgggccttgtacacaccgcccgtcacaccatgggagtggattgcaccagaagtggttagtctaaccttcggggggacgatcactacggtgtggttcatgactggggtgaagtcgtaacaaggtagccgtaggggaacctgcggctggatcacctccttaaac

SEQ ID NO: 9616 - DNA, 1520 bp, Tamlana nanhaiensis
  ref <308>: DATABASE ACCESSION NUMBER: NCBI ACCESSION: NZ_JTDV01000027.1
  ref <309>: DATABASE ENTRY DATE: 2019-04-01
  ref <313>: RELEVANT RESIDUES IN SEQ ID NO: (1)..(1520)
acgatgaagagtttgatcctggctcaggatgaacgctagcggcaggcctaacacatgcaagtcgaggggtaacattggagcttgcttcagatgacgaccggcgcacgggtgcgtaacgcgtatgcaatctaccttttgctgagggatagcccagagaaatttggattaatacctcatagtattacatttttgcatgattatgtaattaaaggttacggcaaaagatgagcatgcgtcctattagctagatggtgtggtaacggcacaccatggcaacgataggtaggggtcctgagagggagatcccccacactggtactgagacacggaccagactcctacgggaggcagcagtgaggaatattggacaatggaggcaactctgatccagccatgccgcgtgcaggaagactgccctatgggttgtaaactgcttttatacaggaagaaaccactctacgtgtagagttctgacggtactgtaagaataaggatcggctaactccgtgccagcagccgcggtaatacggaggatccaagcgttatccggaatcattgggtttaaagggtccgtaggtggataattaagtcagaggtgaaagtctgcagctcaactgtagaattgcctttgatactggttatcttgaattattatgaagtagttagaatatgtagtgtagcggtgaaatgcatagatattacatagaataccaattgcgaaggcagattactaataatatattgacactgatggacgaaagcgtaggtagcgaacgggattagataccccggtagtctacgccgtaaacgatggatactagctgttcggtttcggctgagtggctaagcgaaagtgataagtatcccacctggggagtacgttcgcaagaatgaaactcaaaggaattgacgggggcccgcacaagcggtggagcatgtggtttaattcgatgatacgcgaggaaccttaccagggcttaaatgtaagttgcatgatttagagatagatctttcttcggactacttacaaggtgctgcatggttgtcgtcagctcgtgccgtgaggtgtcaggttaagtcctataacgagcgcaacccctgttgttagttgccagcatgtaaagatgggaactctagcaagactgccggtgcaaaccgtgaggaaggtggggatgacgtcaaatcatcacggcccttacgtcctgggctacacacgtgctacaatggtagggacagagagcagccacttcgcgagaaggagcgaatctataaaccctatcacagttcggatcggagtctgcaactcgactccgtgaagctggaatcgctagtaatcgcatatcagccatgatgcggtgaatacgttcccgggccttgtacacaccgcccgtcaagccatggaagctgggagtgcctgaagtccgtcaccgcaaggagcggcctagggtaaaatcggtaactagggctaagtcgtaacaaggtagccgtaccggaaggtgcggctggaacacctcctttct

SEQ ID NO: 9617 - DNA, 1521 bp, Tamlana sedimentorum
  ref <308>: DATABASE ACCESSION NUMBER: NCBI ACCESSION: NZ_JTDW01000031.1
  ref <309>: DATABASE ENTRY DATE: 2019-04-01
  ref <313>: RELEVANT RESIDUES IN SEQ ID NO: (1)..(1521)
aacgatgaagagtttgatcctggctcaggatgaacgctagcggcaggcctaacacatgcaagtcgaggggtaacattggagcttgcttcagatgacgaccggcgcacgggtgcgtaacgcgtatgcaatctaccttttgctgagggatagcccagagaaatttggattaagacctcatagtattacattttcgcatgaataagtaattaaaggttacggcaaaagatgagcatgcgtcctattagctagatggtgtggtaacggcacaccatggcaacgataggtaggggtcctgagagggagatcccccacactggtactgagacacggaccagactcctacgggaggcagcagtgaggaatattggacaatggagggaactctgatccagccatgccgcgtgcaggaagactgccctatgggttgtaaactgcttttatacaggaagaaaccactctacgtgtagagttctgacggtactgtaagaataaggatcggctaactccgtgccagcagccgcggtaatacggaggatccaagcgttatccggaatcattgggtttaaagggtccgtaggtggataattaagtcagaggtgaaagtttgcggctcaaccgtaaaattgcctttgatactggttatcttgaattattatgaagtggttagaatatgtagtgtagcggtgaaatgcatagatattacatagaataccaattgcgaaggcagatcactaataatatattgacactgatggacgaaagcgtaggtagcgaacgggattagataccccggtagtctacgccgtaaacgatggatactagctgttcggtttcgactgagtggctaagcgaaagtgataagtatcccacctggggagtacgttcgcaagaatgaaactcaaaggaattgacgggggcccgcacaagcggtggagcatgtggtttaattcgatgatacgcgaggaaccttaccagggcttaaatgtaagttgcatgatttagagatagatctttcttcggactacttacaaggtgctgcatggttgtcgtcagctcgtgccgtgaggtgtcaggttaagtcctataacgagcgcaacccctgttgttagttgccagcgagtcatgtcgggaactctagcaagactgccagtgcaaactgtgaggaaggtggggatgacgtcaaatcatcacggcccttacgtcctgggctacacacgtgctacaatggtagggacagagagcagccactgggtgaccaggagcgaatctataaaccctatcacagttcggatcggagtctgcaactcgactccgtgaagctggaatcgctagtaatcgcatatcagccatgatgcggtgaatacgttcccgggccttgtacacaccgcccgtcaagccatggaagctgggagtgcctgaagtccgtcaccgtaaggagcggcctagggtaaaatcggtaactagggctaagtcgtaacaaggtagccgtaccggaaggtgcggctggaacacctcctttct

SEQ ID NO: 9618 - DNA, 1495 bp, Tanticharoenia sakaeratensis
  ref <308>: DATABASE ACCESSION NUMBER: NCBI ACCESSION: NZ_BALE01000067.1
  ref <309>: DATABASE ENTRY DATE: 2019-04-01
  ref <313>: RELEVANT RESIDUES IN SEQ ID NO: (1)..(1495)
atgaacctgagagtttgatcctggctcagagcgaacgctggcggcatgcttaacacatgcaagtcgcacggacctttcggggttagtggcggacgggtgagtaacgcgtaggtatctatccatgggtgggggacaactctgggaaactggagctaataccgcatgacacctgagggtcaaaggcgcaagtcgcctgtggaggagcctgcgttcgattagcttgttggtggggtaatggcctaccaaggcgatgatcgatagctggtctgagaggatgatcagccacactgggactgagacacggcccagactcctacgggaggcagcagtggggaatattggacaatgggcgcaagcctgatccagcaatgccgcgtgtgtgaagaaggtcttcggattgtaaagcactttcgacggggacgatgatgacggtacccgtagaagaagccccggctaacttcgtgccagcagccgcggtaatacgaagggggctagcgttgctcggaatgactgggcgtaaagggcgcgtaggcggttgttacagtcagatgtgaaatcccagggcttaaccttggagctgcatttgatacgtgacgactagagttcgagagagggttgtggaattcccagtgtagaggtgaaattcgtagatattgggaagaacaccggtggcgaaggcggcaacctggctcgatactgacgctgaggcgcgaaagcgtggggagcaaacaggattagataccctggtagtccacgctgtaaacgatgtgtgctggatgttggggtgcttagcacttcagtgtcgtagttaacgcgataagcacaccgcctggggagtacggccgcaaggttgaaactcaaaggaattgacgggggcccgcacaagcggtggagcatgtggtttaattcgaagcaacgcgcagaaccttaccagggcttgacatggggaggtcgtgtccagagatgggcatttcccgcaagggacctcctgcacaggtgctgcatggctgtcgtcagctcgtgtcgtgagatgttgggttaagtcccgcaacgagcgcaaccctcgcctttagttgccagcatgtttgggtgggcactctagaggaactgccggtgacaagccggaggaaggtggggatgacgtcaagtcctcatggcccttatgtcctgggctacacacgtgctacaatggcggtgacagtgggaagctatgtggtgacacaatgctgatctctaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggttcgaccttaagccggtgagcgaaccgcaaggacgcagccgaccacggtcgggtcagcgactggggtgaagtcgtaacaaggtagccgtaggggaacctgcggctggatcacctcctttcaag

SEQ ID NO: 9619 - DNA, 1493 bp, Tardiphaga sp. OV697
  ref <308>: DATABASE ACCESSION NUMBER: NCBI ACCESSION: NZ_QENW01000025.1
  ref <309>: DATABASE ENTRY DATE: 2019-04-01
  ref <313>: RELEVANT RESIDUES IN SEQ ID NO: (1)..(1493)
tccaacttgagagtttgatcctggctcagagcgaacgctggcggcaggcttaacacatgcaagtcgaacgggcgtagcaatacgtcagtggcagacgggtgagtaacgcgtgggaacatacctcttggttcggaacaacacagggaaacttgtgctaataccggataagcccttacggggaaagatttatcgccgagagattggcccgcgtctgattagctagttggtagggtaatggcctaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtacgggaagataatgacggtaccgtaagaataagccccggctaacttcgtgccagcagccgcggtaatacgaagggggctagcgttgctcggaatcactgggcgtaaagggtgcgtaggcgggtttttaagtcagaggtgaaatcctggagctcaactccagaactgcctttgatactgaaagtcttgagtatgggagaggtgagtggaactgcgagtgtagaggtgaaattcgtagatattcgcaagaacaccagtggcgaaggcggctcactggcccataactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtctatgaccggtaccagagatggaaccttcccttcggggcatagagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgcaaaggggcgacccctcgcaaatctcaaaaagccgtctcagttcggattgggctctgcaactcgagcccatgaagttggaatcgctagtaatcgtggatcagcatgccacggtgaatacgttcccgggccttgtacacaccgcccgtcacaccatgggagttggttctacctgaaggcagtgcgctaaccgcaagggggcagctgaccacggtagggtcagcgactggggtgaagtcgtaacaaggtagccgtaggggaacctgcggctggatcacctcctttctaa

SEQ ID NO: 9620 - DNA, 1493 bp, Tardiphaga sp. YR296
  ref <308>: DATABASE ACCESSION NUMBER: NCBI ACCESSION: NZ_RAPX01000007.1
  ref <309>: DATABASE ENTRY DATE: 2019-04-01
  ref <313>: RELEVANT RESIDUES IN SEQ ID NO: (1)..(1493)
tccaacttgagagtttgatcctggctcagagcgaacgctggcggcaggcttaacacatgcaagtcgaacgggcgtagcaatacgtcagtggcagacgggtgagtaacgcgtgggaacatacctcttggttcggaacaacacagggaaacttgtgctaataccggataagcccttacggggaaagatttatcgccgagagattggcccgcgtctgattagctagttggtggggtaaaggcctaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtacgggaagataatgacggtaccgtaagaataagccccggctaacttcgtgccagcagccgcggtaatacgaagggggctagcgttgctcggaatcactgggcgtaaagggtgcgtaggcgggtttttaagtcagaggtgaaatcctggagctcaactccagaactgcctttgatactgaaagtcttgagtatgggagaggtgagtggaactgcgagtgtagaggtgaaattcgtagatattcgcaagaacaccagtggcgaaggcggctcactggcccataactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtctatgaccggtaccagagatggaaccttcccttcggggcatagagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgcaaaagggcgacctctcgcaaatctcaaaaagccgtctcagttcggattgggctctgcaactcgagcccatgaagttggaatcgctagtaatcgtggatcagcatgccacggtgaatacgttcccgggccttgtacacaccgcccgtcacaccatgggagttggttctacctgaaggcagtgcgctaaccgcaagggggcagctgaccacggtagggtcagcgactggggtgaagtcgtaacaaggtagccgtaggggaacctgcggctggatcacctcctttctaa

SEQ ID NO: 9621 - DNA, 1463 bp, Tateyamaria omphalii
  ref <308>: DATABASE ACCESSION NUMBER: NCBI ACCESSION: NZ_CP019312.1
  ref <309>: DATABASE ENTRY DATE: 2019-04-01
  ref <313>: RELEVANT RESIDUES IN SEQ ID NO: (1)..(1463)
tcaacttgagagtttgatcctggctcagaacgaacgctggcggcaggcctaacacatgcaagtcgagcgcaccttcgggtgagcggcggacgggttagtaacgcgtgggaatatacccttctctgcggaatagcctctggaaacggagagtaataccgcatacgcccttcgggggaaagatttatcggagaaggattagcccgcgttagattaggtagttggtggggtaatggcctaccaagcctacgatctatagctggttttagaggatgatcagcaacactgggactgagacacggcccagactcctacgggaggcagcagtggggaatcttagacaatgggggaaaccctgatctagccatgccgcgtgagtgatgaaggccctagggtcgtaaagctctttcgccagggatgataatgacagtacctggtaaagaaaccccggctaactccgtgccagcagccgcggtaatacggagggggttagcgttgttcggaattactgggcgtaaagcgcacgtaggcggactattaagtgaggggtgaaatcccagggctcaaccctggaactgcctctcatactggtagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagtatactattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgacaactcgagagatcgagcgttccttagggacacagtgacaggtgctgcatggctgtcgtcagctcgtgtcgtgagatgttcggttaagtccggcaacgagcgcaacccacatctttagttgccagcagttcggctgggcactctaaagaaactgcccgtgataagcgggaggaaggtgtggatgacgtcaagtcctcatggcccttacgggttgggctacacacgtgctacaatggtacctacagtgggttaatccccaaaaggtatctcagttcggattggggtctgcaactcgaccccatgaagtcggaatcgctagtaatcgcagaacagcatgctgcggtgaatacgttcccgggccttgtacacaccgcccgtcacaccatgggagttggttctacccgacggccgtgcgctaaccttttggaggcagcggaccacggtaggatcagcgactggggtgaagtcgtaacaaggtagccgtaggggaacctgcggctggatcacctcctttctaa

SEQ ID NO: 9622 - DNA, 1463 bp, Tateyamaria sp. ANG-S1
  ref <308>: DATABASE ACCESSION NUMBER: NCBI ACCESSION: NZ_JWLL01000005.1
  ref <309>: DATABASE ENTRY DATE: 2019-04-01
  ref <313>: RELEVANT RESIDUES IN SEQ ID NO: (1)..(1463)
tcaacttgagagtttgatcctggctcagaacgaacgctggcggcaggcctaacacatgcaagtcgagcgcaccttcgggtgagcggcggacgggttagtaacgcgtgggaacgtgcccttctctgcggaatagccactggaaacggtgagtaataccgcatacgcccttcgggggaaagatttatcggagaaggatcggcccgcgttagattaggtagttggtggggtaacggcctaccaagcctacgatctatagctggttttagaggatgatcagcaacactgggactgagacacggcccagactcctacgggaggcagcagtggggaatcttagacaatgggggaaaccctgatctagccatgccgcgtgagtgatgaaggccctagggtcgtaaagctctttcgccagggatgataatgacagtacctggtaaagaaaccccggctaactccgtgccagcagccgcggtaatacggagggggttagcgttgttcggaattactgggcgtaaagcgcacgtaggcggactattaagtgaggggtgaaatcccggggctcaaccccggaactgcctctcatactggtagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagtatactattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgacaactcgagagatcgagcgttccttagggacacagtgacaggtgctgcatggctgtcgtcagctcgtgtcgtgagatgttcggttaagtccggcaacgagcgcaacccacatctttagttgccagcagttcggctgggcactctaaagaaactgcccgtgataagcgggaggaaggtgtggatgacgtcaagtcctcatggcccttacgggttgggctacacacgtgctacaatggcaagtacagtgggttaatccccaaaacttgtctcagttcggattggggtctgcaactcgaccccatgaagtcggaatcgctagtaatcgcagaacagcatgctgcggtgaatacgttcccgggccttgtacacaccgcccgtcacaccatgggagttggttctacccgacggccgtgcgctaaccttttggaggcagcggaccacggtaggatcagcgactggggtgaagtcgtaacaaggtagccgtaggggaacctgcggctggatcacctcctttctaa

SEQ ID NO: 9623 - DNA, 1463 bp, Tateyamaria sp. Alg231-49
  ref <308>: DATABASE ACCESSION NUMBER: NCBI ACCESSION: NZ_FRFA01000015.1
  ref <309>: DATABASE ENTRY DATE: 2019-04-01
  ref <313>: RELEVANT RESIDUES IN SEQ ID NO: (1)..(1463)
tcaacttgagagtttgatcctggctcagaacgaacgctggcggcacgcctaacacatgcaagtcgagcgcaccttcgggtgagcggcggacgggttagtaacgcgtgggaacatacccttctctaaggaatagtcactggaaacggtgagtaataccttatacgcccttcgggggaaagatttatcggagatggattggcccgcgttagattagatagttggtggggtaacggcctaccaagtctacgatctatagctggttttagaggatgatcagcaacactgggactgagacacggcccagactcctacgggaggcagcagtggggaatcttagacaatgggcgaaagcctgatctagcgatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcacgtaggcggactattaagtgaggggtgaaatcccagggctcaaccctggaactgcctctcatactggtagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcagcaagtatacttgttggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgacaactcgagagatcgagcgttccttagggacacagtgacaggtgctgcatggctgtcgtcagctcgtgtcgtgagatgttcggttaagtccggcaacgagcgcaacccacatctttagttgccagcagttcggctgggcactctaaagaaactgcccgtgataagcgggaggaaggtgtggatgacgtcaagtcctcatggcccttacgggttgggctacacacgtgctacaatggcaagtacagtgggttaatccccaaaacttgtctcagttcggattggggtctgcaactcgaccccatgaagtcggaatcgctagtaatcgcagaacagcatgctgcggtgaatacgttcccgggccttgtacacaccgcccgtcacaccatgggagttggttctacccgacggccgtgcgctaaccttttggaggcagcggaccacggtaggatcagcgactggggtgaagtcgtaacaaggtagccgtaggggaacctgcggctggatcacctcctttctaa

SEQ ID NO: 9624 - DNA, 1550 bp, Tatumella citrea
  ref <308>: DATABASE ACCESSION NUMBER: NCBI ACCESSION: NZ_CP015581.1
  ref <309>: DATABASE ENTRY DATE: 2019-04-01
  ref <313>: RELEVANT RESIDUES IN SEQ ID NO: (1)..(1550)
ttaaattgaagagtttgatcatggctcagattgaacgctggcggcaggcctaacacatgcaagtcgaacggtagcacagaggagcttgctccttgggtgacgagtggcggacgggtgagtaatgtctgggaaactgcctgatggagggggataactactggaaacggtagctaataccgcataacgtcgcaagaccaaagtgggggaccttcgggcctcacaccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagtcaggaggaagggtgtagtcttaatacggctatgcattgacgttactgacagaagaagcaccggctaactccgtgccagcagccgcggtaatacggagggtgcaagcgttaatcggaattactgggcgtaaagcgcacgcaggcggtctgtcaagtcggatgtgaaatccccgggctcaacccgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccctatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtagatagcttaaccttcgggagggcgtttaccactttgtgattcatgactggggtgaagtcgtaacaaggtaaccgtaggggaacctgcggttggatcacctccttacctgaa

SEQ ID NO: 9625 - DNA, 1552 bp, Tatumella sp. OPLPL6
  ref <308>: DATABASE ACCESSION NUMBER: NCBI ACCESSION: NZ_MTCG01000053.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacagagagtagcttgctactttgctgacgagtggcggacgggtgagtaatgtctggggatctgcctgatggagggggataactactggaaacggtagctaataccgcataatgtcgcaagaccaaagcgggggactttcgggcctcgcaccatcagatgaacccagatgggattagctagtaggtaaggtaatggcttacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagtcaggaggaagggtgtgaaattaatactttcatgcattgacgttactgacagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggctgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttagcagagatgctttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtaaatcagaatgttacggtgaatacgttcccgggccttgtacacaccgcccgtcacaccatgggagtgggttgcaaaagaagtagatagcttaaccttcgggagggcgtttaccactttgtgattcatgactggggtgaagtcgtaacaaggtaaccgtaggggaacctgcggttggatcacctccttacctgtaaga

SEQ ID NO: 9626 - DNA, 1550 bp, Taylorella equigenitalis
  ref <308>: DATABASE ACCESSION NUMBER: NCBI ACCESSION: NZ_LR134346.1
  ref <309>: DATABASE ENTRY DATE: 2019-04-01
  ref <313>: RELEVANT RESIDUES IN SEQ ID NO: (1)..(1550)
attgaactgaagagtttgatcctggctcagattgaacgctagcggaatgccttacacatgcaagtcgaacggcagcataaggagagcttgcttttcttgatggcgagtggcgaacgggtgagtaaagtatcggaacgtgcccagtagcgggggataactacgcgaaagcgtagctaataccgcatacgccctgagggggaaagagggggatcagagatgaccttttactattggagcggccgatatcggattagctagttggtggggtaaaggcctaccaaggcgacgatccgtagctggtttgagaggacgaccagccacactgggactgagacacggcccagactcctacgggaggcagcagtggggaattttggacaatgggggcaaccctgatccagccattccgcgtgtgcgattgaaggccttcgggttgtaaagcacttttgtcagggaagaaaaggtttgtgttaataccatggactgctgacggtacctgaagaataagcaccggcaaactacgtgccagcagccgcggtaatacgtagggtgcgagcgttaatcggaattactgggcgtaaagcgtgcgcaggcggttcggaaagagagatgtgaaatcccagggctcaaccttggaactgcatttctaactgtcgagctagagtatgttagaggggggtagaattccacgtgtagcagtgaaatgcgtagagatgtggaggaataccgatggcgaaggcagccccctgggataatactgacgctgatgcacgaaagcgtggggagcaaacaggattagataccctggtagtccacgccctaaacgatgtcaactagctgttgggacttacgggtcttggtagcgaagccaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtttggaatcctgaagagatttaggagtgctcgcaagagaaccgaaacacaggtgctgcatggctgtcgtcagctcgtgtcgtgagatgttgggttaagtcccgcaacgagcgcaacccttgtcattagttgctacaagtaagatgggcactctaatgagactgccggtgataaaccggaggaaggtggggatgacgtcaagtcctcatggcccttatgggtagggcttcacacgtcatacaatggtcaggacagagggaagccaaaccgcgaggtggagctaatctcacaaacctgatcgtagtccggattgcaggctgcaactcgcctgcatgaagtcggaatcgctagtaatcgcggatcagcatgtcgcggtgaatacgttcccgggtcttgtacacaccgcccgtcacaccatgggagtgggttttaccagaagtagttagtctaaccgcaaggagggcgattaccacggtaggattcatgactggggtgaagtcgtaacaaggtagccgtagcggaagctgtggctggatcacctccttt

SEQ ID NO: 9627 - DNA, 1493 bp, Telmatospirillum siberiense
  ref <308>: DATABASE ACCESSION NUMBER: NCBI ACCESSION: NZ_PIUM01000067.1
  ref <309>: DATABASE ENTRY DATE: 2019-04-01
  ref <313>: RELEVANT RESIDUES IN SEQ ID NO: (1)..(1493)
ttaacttgagagtttgatcctggctcagaacgaacgctggcggcatgcctaacacatgcaagtcgaacgaaggcttcggccttagtggcgcacgggtgagtaacgcgtgggaatctgcctagcagtggggaataacgatgggaaactgtcgctaataccgcatacgcccttcgggggaaagatttattgctgttagatgagcccgcgtccgattaggtagttggtggggtaaaggcctaccaagccttcgatcggtagctggtctgagaggatgatcagccacactgggactgagacacggcccagactcctacgggaggcagcagtggggaatattggacaatgggggaaaccctgatccagcaatgccgcgtgagtgatgaaggccttagggttgtaaagctctttcgggtgggacgatgatgacggtaccaccagaagaagccccggctaacttcgtgccagcagccgcggtaatacgaagggggctagcgttgttcggaattactgggcgtaaagcgcacgcaggcggctcgttaaattagaagtgaaagccctgggctcaacccgggaattgcttttaagactggcgagcttgaattcggaagagggcagtggaattccaagtgtagaggtgaaattcgtagatatttggaagaacaccagtggcgaaggcgactgcctggtccgatattgacgctcatgtgcgaaagcgtggggagcaaacaggattagataccctggtagtccacgctgtaaacgatgagtgctagttgttggggtgcatgcacctcagtgacgcagctaacgcattaagcactccgcctggggagtacggccgcaaggttaaaactcaaaggaattgacgggggcccgcacaagcggtggagcatgtggtttaattcgaagcaacgcgcagaaccttaccaacctttgacatgggacgtttgatttccagagatggatttcttcagttcggctggcgtccacacaggtgctgcatggctgtcgtcagctcgtgtcgtgagatgttgggttaagtcccgcaacgagcgcaaccctcatcttcagttgccatcagttcggctgggcactctgaagaaactgccggtgacaagccggaggaaggtggggatgacgtcaagtcctcatggcccttacaggttgggctacacacgtgctacaatggcggtgacaatgggttgctaacccgcgagggcaagctaatctccaaaagccgtctcagttcggattgcactctgcaactcgagtgcatgaagtcggaatcgctagtaatcgtggatcagcatgccacggtgaatacgttcccgggccttgtacacaccgcccgtcacaccatgggagttggttttacccgaagccggtgcgctaaccgcaaggaggcagccgaccacggtaaggtcagcgactggggtgaagtcgtaacaaggtagccgtaggggaacctgcggctggatcacctcctttcaagg

SEQ ID NO: 9628 - DNA, 1530 bp, Tepidanaerobacter acetatoxydans
  ref <308>: DATABASE ACCESSION NUMBER: NCBI ACCESSION: NC_019954.2
  ref <309>: DATABASE ENTRY DATE: 2019-04-01
  ref <313>: RELEVANT RESIDUES IN SEQ ID NO: (1)..(1530)
aacatgagagtttgatcctggctcaggacgaacgctggcggcgtgcctaacacatgcaagtcgagcgaagtttaagcagtagcgacttcggtcaaagcagcttaaacttagcggcggacgggtgagtaacacgtaggcaacctgcccatgacacggggatagcttcgggaaaccgaaggtaatacccgatacctttacacattgcataatgtataaagaaagcgactaagcggtcatggatgggcctgcgtcccattagctagttggtgagataacagcccaccaaggcgacgatgggtagccggcctgagagggcgaccggccacactggaacttagacacggtccagactcctacgggaggcagcagtggggaattttgcgcaatgggggaaaccctgacgcagcgacgccgcgtgagcgaagaaggccttcgggtcgtaaagctcagtcattggggatgaaaaggacagtacccaaagaggaagccccggctaactacgtgccagcagccgcggtaatacgtagggggcgagcgttgtccggaattactgggtgtaaagggcgtgtaggcggggatgcaagttaccggtaaaaacccgaggctcaaccacgggcttgccgataaaactgtatctcttgagtataggagagggaagtggaatttccggagtagcggtgaaatgcgtagataccgggaagaacaccagtggcgaaggcggcttcctggcctatcactgacgctgaggcgcgaaagctagggtagcgaacgggattagataccccggtagtcctagccgtaaacgatggtcactaggtgtgggtggtggtcaagccatccgtgccggagctaacgcaataagtgacccacctggggagtacggccgcaaggttgaaactcaaaggaattgacgggggcccgcacaagcggtggagcatgtggtttaattcgaagcaacgcgaagaaccttaccaggccttgacatataggtagtagagagcggaaacgcaatcgaccttagggaaacctaaggagcctatacaggtggtgcatggttgtcgtcagctcgtgtcgtgagatgttgggttaagtcccgcaacgagcgcaacccctatacttagttgccagcacataaggtgggcactctaagtagactgccgtcgataagacggaggaaggtggggacgacgtcaaatcatcatgccctttatggtctgggcgacacacgtgctacaatggcctaaacaacgggcagcgaaggagcgatcctgagcgaatccctaaaaacaggtctcagttcggattgcaggctgcaactcgcctgcatgaagtaggaatcgctagtaatcgcggatcagcatgccgcggtgaatacgttctcgggccttgtacacaccgcccgtcacaccacgaaagttggcaacacccgaagccgggattaaccgtcgaaggtggggccagcgattggggtgaagtcgtaacaaggtagccgtatcggaaggtgcggctggatcacctcctttctaagga

SEQ ID NO: 9629 - DNA, 1292 bp, Tepidibacillus sp. HK-1
  ref <308>: DATABASE ACCESSION NUMBER: NCBI ACCESSION: NZ_BDGM01000036.1
  ref <309>: DATABASE ENTRY DATE: 2019-04-01
  ref <313>: RELEVANT RESIDUES IN SEQ ID NO: (1)..(1292)
agggtaacggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggattgtaaaactctgtcattagggaagaacaagtataggatgaacaagcctgtaccttgacggtacctaaggaggaagccccggctaactacgtgccagcagccgcggtaatacgtagggggcaagcgttgtccggaattattgggcgtaaagcgcgcgcaggcggttctttaagtctgatgtgaaagcccacggctcaaccgtggagggtcattggaaactggaggacttgagtgcaggagagggaagtggaattccacgtgtagcggtgaaatgcgtagagatgtggaggaacaccagtggcgaaggcgactttctggcctgtaactgacgctgaggcgcgaaagcgtggggagcaaacaggattagataccctggtagtccacgccgtaaacgatgagtgctaggtgttaggggtttcgatacccttagtgccgaagttaacacattaagcactccgcctggggagtacggccgcaaggctgaaactcaaaggaattgacgggggcccgcacaagcagtggagcatgtggtttaattcgaagcaacgcgaagaaccttaccagggcttgacatcccgttgcctggtctagagatagacctttcccttcggggacaacggtgacaggtggtgcatggttgtcgtcagctcgtgtcgtgagatgttgggttaagtcccgcaacgagcgcaacccttaatcttagttgccagcattcagatgggcactctaaggtgactgccggtgacaaaccggaggaaggtggggatgacgtcaaatcatcatgccccttatgtcctgggctacacacgtgctacaatggctggtacaaagggtagcgaagccgtgaggtggagccaatcccaaaaaaccagtctcagttcggattgtaggctgcaactcgcctacatgaagccggaattgctagtaatcgcggatcagcatgccgcggtgaatacgttcccgggccttgtacacaccgcccgtcacaccacgagagtttgcaacacccgaagtcggtgaggtaaccgcaaggagccagccgccgaaggtggggtagatgattggggtgaagtcgtaacaaggtagccgtatcggaaggtgcggctggatcacctcctttcta

SEQ ID NO: 9630 - DNA, 1100 bp, Tepidibacter formicigenes
  ref <308>: DATABASE ACCESSION NUMBER: NCBI ACCESSION: NZ_FRAE01000001.1
  ref <309>: DATABASE ENTRY DATE: 2019-04-01
  ref <313>: RELEVANT RESIDUES IN SEQ ID NO: (1)..(1100)
tatacacatggataacataccgaaaggtatgctaatacaagataatactaagataaggcatcttattttagtcaaagcgttagcggtataggatggacccgcgtcccattagctagttggtgaggtaacggctcaccaaggccacgatgggtagccgacctgagagggtgatcggccacactggaactgagacacggtccagactcctacgggaggcagcagtggggaatattgcacaatgggggaaaccctgatgcagcaacgccgcgtgagcgatgaaggccttcgggtcgtaaagctctgtcctaagggaagaatactgacggtaccttaggaggaagccccggctaactacgtgccagcagccgcggtaatacgtagggggctagcgttatccggaattactgggcgtaaagggtgcgtaggcggcccttcaagtcagaggtgaaaggctacggctcaaccgtagtaagcctttgaaactgtagggcttgagtgcaggagaggagagtggaattcccagtgtagcggtgaaatgcgtagatattgggaggaacaccagttgcgaaggcggctctctggactgtaactgacgctgaggcacgaaagcgtggggagcgaacaggattagataccctggtagtccacgccgtaaacgatgagtgctaggtgtcgggggttacccccctcggtgccgcagctaacgcattaagcactccgcctgggaagtacgctcgcaagagtgaaactcaaaggaattgacggggacccgcacaagcagcggagcatgtggtttaattcgaagcaacgcgaagaaccttacctaggcttgacatcccttggaccgcttcttaaccgaagctttcccttttgggactgaggtgacaggtggtgcatggttgtcgtcagctcgtgtcgtgagatgttgggttaagtcccgcaacgagcgcaacccttacctttagttgccagcatttaggatgggcactctagagggactgccgaggataactcggaggaaggtggggatgacgtcaaatcatcatgccccttatgcttagggctacacacgtgctacaatggctagtacagagggttgc

SEQ ID NO: 9631 - DNA, 1170 bp, Tepidibacter thalassicus
  ref <308>: DATABASE ACCESSION NUMBER: NCBI ACCESSION: NZ_FQXH01000004.1
  ref <309>: DATABASE ENTRY DATE: 2019-04-01
  ref <313>: RELEVANT RESIDUES IN SEQ ID NO: (1)..(1170)
gaaaagagcttgctcttggatcctagcggcggacgggtgagtaacgcgtgggtaacctgccctatacacacggataacataccgaaaggtatgctaatacgggataaagctaagataaggcatcttatcatagtcaaagcgaaagcggtataggatgggcccgcgtcccattagctagttggtgaggtaaaagctcaccaaggcgacgatgggtagccgacctgagagggtgatcggccacactggaactgagacacggtccagactcctacgggaggcagcagtggggaatattgcacaatgggggaaaccctgatgcagcaacgccgcgtgagcgaagaaggccttcgggtcgtaaagctctgtcctaagggaagaaggattgacggtaccttaggaggaagccccggctaactacgtgccagcagccgcggtaatacgtagggggcaagcgttatccggaattactgggcgtaaagggtgcgtaggcggctgtacaagtcagaggtgaaaggctacggctcaaccgtagtaagcctttgaaactgtacggcttgagtgcaggagaggagagtagaattcccagtgtagcggtgaaatgcgtagatattgggaggaataccagttgcgaaggcggctctctggactgtaactgacgctgaggcacgaaagcgtggggagcgaacaggattagataccctggtagtccacgccgtaaacgatgagtgctaggtgtcgggggttacccccctcggtgccgcagctaacgcattaagcactccgcctggggagtacgctcgcaagagtgaaactcaaaggaattgacggggacccgcacaagcagcggagcatgtggtttaattcgaagcaacgcgaagaaccttacctaggcttgacatccctcggaccgcttcttaatagaagctttcccttatgggactgaggagacaggtggtgcatggttgtcgtcagctcgtgtcgtgagatgttgggttaagtcccgcaacgagcgcaacccttacctttagttgccagcacttagggtgggcactctagagggactgccgaggacaactcggaggaaggtggggatgacgtcaaatcatcatgccccttatgcctagggctacacacgtgctacaatggctagtacagagggaagcgaaactg

SEQ ID NO: 9632 - DNA, 1186 bp, Tepidicaulis marinus
  ref <308>: DATABASE ACCESSION NUMBER: NCBI ACCESSION: NZ_BBIO01000034.1
  ref <309>: DATABASE ENTRY DATE: 2019-04-01
  ref <313>: RELEVANT RESIDUES IN SEQ ID NO: (1)..(1186)
cctacgggaggcagcagtggggaatcttgcacaatgggcgaaagcctgatgcagccatgccgcgtgagtgaagaaggccctagggttgtaaaactctttcagtggggaagataatgacggtacccacagaagaagctccggctaactccgtgccagcagccgcggtaatacggagggagctagcgttgttcggaattactgggcgtaaagcgcacgtaggcggactgatcagttgggggtgaaagcccagggctcaaccctggaactgccttcaatactgtcagtcttgagtccgagagaggtgagtggaatttccagtgtagaggtgaaattcgtagatattggaaagaacaccagtggcgaaggcggctcactggctcggtactgacgctgaggtgcgaaagtgtggggagcaaacaggattagataccctggtagtccacaccgtaaacgatggatgctagttgtcgggcagcatgctgttcggtgacgcagctaacgcattaagcatcccgcctggggagtacggtcgcaagattaaaactcaaaggaattgacgggggcccgcacaagcggtggagcatgtggtttaattcgaagcaacgcgcagaaccttaccaacccttgacatcccgatcgcggttaccagagatggtttccttcagctcggctggatcggtgacaggtgttgcatggctgtcgtcagctcgtgtcgtgagatgttgggttaagtcccgcaacgagcgcaaccctcgcctttagttgccagcattaagttgggcactctagagggactgccggtgataagccggaggaaggtggggatgacgtcaagtcctcatggcccttacgggttgggctacacacgtgctacaatggcggcgacagagggcagcgataccgcgaggtggagcaaatccctaaaagccgtctcagttcggattgttctctgcaactcgagagcatgaaggtggaatcgctagtaatcgcagaacagcatgctgcggtgaatacgttcccgggccttgtacacaccgcccgtcacatcatgggagttggctttgcccgaaggcggtgcgctaaccagcaatggaagcagccgaccacggtaaggtcagcgactgggatgaagtcgtaacaaggtagccgtaggggaacctgcggctggatcacctcctttctaagg

SEQ ID NO: 9633 - DNA, 1504 bp, Tepidicaulis sp. EA10
  ref <308>: DATABASE ACCESSION NUMBER: NCBI ACCESSION: NZ_REFL01000005.1
  ref <309>: DATABASE ENTRY DATE: 2019-04-01
  ref <313>: RELEVANT RESIDUES IN SEQ ID NO: (1)..(1504)
tcaatttgagagtttgatcctggctcagaacgaacgctggcggcaggcttaacacatgcaagtcgaacgcgaacgcaccttcgggtgttagtagagtggcagacgggtgagtaacgcgtgggaacctacctaggggtacggaataacgcagggaaacttgtgctaataccgtatacgtccttcgggagaaagatttatcgcccctagatgggcccgcgttggattagcttgttggtgaggtaatggctcaccaaggctacgatccatagctggtctgagaggatgatcagccacactgggactgagacacggcccagactcctacgggaggcagcagtggggaatcttgcacaatgggcgaaagcctgatgcagccatgccgcgtgagtgaagaaggccctagggttgtaaaactctttcagtggggaagataatgacggtacccacagaagaagctccggctaactccgtgccagcagccgcggtaatacggagggagctagcgttgttcggaattactgggcgtaaagcgcacgtaggcggactgatcagttgggggtgaaagcccagggctcaaccctggaactgccttcaatactgtcagtcttgagtccgagagaggtgagtggaatttccagtgtagaggtgaaattcgtagatattggaaagaacaccagtggcgaaggcggctcactggctcggtactgacgctgaggtgcgaaagtgtggggagcaaacaggattagataccctggtagtccacaccgtaaacgatggatgctagttgtcgggcagcatgctgttcggtgacgcagctaacgcattaagcatcccgcctggggagtacggtcgcaagattaaaactcaaaggaattgacgggggcccgcacaagcggtggagcatgtggtttaattcgaagcaacgcgcagaaccttaccaacccttgacatcccgatcgcggttaccagagatggtttccttcagctcggctggatcggtgacaggtgttgcatggctgtcgtcagctcgtgtcgtgagatgttgggttaagtcccgcaacgagcgcaaccctcgcctttagttgccagcattaagttgggcactctagagggactgccggtgataagccggaggaaggtggggatgacgtcaagtcctcatggcccttacgggttgggctacacacgtgctacaatggcggcgacagagggcagcgataccgcgaggtggagcaaatccctaaaagccgtctcagttcggattgttctctgcaactcgagagcatgaaggtggaatcgctagtaatcgcagaacagcatgctgcggtgaatacgttcccgggccttgtacacaccgcccgtcacatcatgggagttggctttgcccgaaggcggtgcgctaaccagcaatggaagcagccgaccacggtaaggtcagcgactgggatgaagtcgtaacaaggtagccgtaggggaacctgcggctggatcacctcctttctaa

SEQ ID NO: 9634 - DNA, 1511 bp, Terasakiella pusilla
  ref <308>: DATABASE ACCESSION NUMBER: NCBI ACCESSION: NZ_JHYO01000068.1
  ref <309>: DATABASE ENTRY DATE: 2019-04-01
  ref <313>: RELEVANT RESIDUES IN SEQ ID NO: (1)..(1511)
tcaacttgagagtttgatcctggctcagaacgaacgctggcggcaggcctaacacatgcaagtcgagggagaagctatcttcggatagtggagaccggcagacgggtgagtaacacgtgggaacataccgagtagtgggggataacagttggaaacgactgctaataccgcatacgcccttcgggggaaagatttatcgctattcgattggcccgcgttagattagctagttggtaaggtaacggcttaccaaggcgacgatctatagctggtttgagaggatgatcagccacactgggactgagacacggcccagactcctacgggaggcagcagtggggaatattgcgcaatggaggaaactctgacgcagccatgccgcgtgagtgaagaaggccttagggttgtaaagctctttcagacgtgatgatgatgacagtagcgtcaaaagaagttccggctaacttcgtgccagcagccgcggtaatacgaagggaactagcgttgttcggatttactgggcgtaaagagcatgtaggcggattggacagttgagggtgaaatcccagagctcaactctggaacggccttcaatacttccagtctagagtccgtaagggggtggtggaattccgagtgtagaggtgaaattcgtagatattcggaggaacaccagtggcgaaggcgaccacctggtacggtactgacgctgagatgcgaaagcgtggggagcaaacaggattagataccctggtagtccacgccgtaaacgatgagtgctagttgtcaggatgtttacatcttggtgacgcagctaacgcattaagcactccgcctggggagtacggtcgcaagattaaaactcaaaggaattgacgggggcccgcacaagcggtggagcatgtggtttaattcgaagcaacgcgaagaaccttaccaattcttgacatacctgtcgcgatttccagagatggatttcttcagttcggctggacaggatacaggtgctgcatggctgtcgtcagctcgtgtcgtgagatgttgggttaagtcccgcaacgagcgcaaccctcacccctagttgccagcatttagttgggcactctatgggaactgccggtgacaagccggaggaaggtggggatgacgtcaagtcatcatggcccttacggattgggctacacacgtgctacaatggtaactacagtgggcagcgacgtcgcgaggcgaagcaaatctccaaaagttatctcagttcggattgttctctgcaactcgagagcatgaagtcggaatcgctagtaatcgcggatcagcatgccgcggtgaatacgttcccgggccttgtacacaccgcccgtcacaccatgggagttggttttacccgaagacggtgggctaacctttttaaggaggcagccggccacggtaaggtcagcgactggggtgaagtcgtaacaaggtagccgtaggggaacctgcggctggatcacctcctttcaaggaagatt

SEQ ID NO: 9635 - DNA, 1533 bp, Teredinibacter turnerae
  ref <308>: DATABASE ACCESSION NUMBER: NCBI ACCESSION: NZ_LANC01000013.1
  ref <309>: DATABASE ENTRY DATE: 2019-04-01
  ref <313>: RELEVANT RESIDUES IN SEQ ID NO: (1)..(1533)
taaactgaagagtttgatcatggctcagattgaacgctggcggcaggcctaacacatgcaagtcgagcgtgaaagccttcgggtgagtaaagcggcggacgggtgagtaacgcgtgggaatctgcctggtagtgggggacaacagtcggaaacgactgctaataccgcatacgtcctaagggagaaagtgggggatcttcggacctcacgctatcagatgagcccgcgtcggattagctagtaggtgaggtaatggctcacctaggcgacgatccgtagctggtctgagaggatgatcagccacattgggactgagacacggcccaaactcctacgggaggcagcagtggggaatattgcacaatgggggaaaccctgatgcagccatgccgcgtgtgtgaagaaggccctcgggttgtaaagcactttcagcagtgaggaaaggttgtacgttaatagcgtgcaactgtgacgttaactgcagaagaagcaccggctaactccgtgccagcagccgcggtaatacggagggtgcgagcgttaatcggaattactgggcgtaaagcgcgcgtaggcggttatttaagctagatgtgaaagccctgggctcaacctgggaactgcatttagaactgggtaacttgagtacagcagaggatagtggaatttcaggtgtagcggtgaaatgcgtagagatctgaaggaacatcagtggcgaaggcgactgtctgggctgatactgacgctgaggtgcgaaagcgtggggagcaaacaggattagataccctggtagtccacgccgtaaacgatgtctactagccgttggtctccttgagggattagtggcgcagctaacgcagtaagtagaccgcctggggagtacggtcgcaagattaaaactcaaatgaattgacgggggcccgcacaagcggtggagcatgtggtttaattcgaagcaacgcgaagaaccttaccaggtcttgacatcctagaaacttagcagagatgctttggtgccttcgggaatctagagacaggtgctgcatggctgtcgtcagctcgtgtcgtgagatgttgggttaagtcccgtaacgagcgcaacccttgtccttagttgccatcagttcggctgggaactctaaggagactgccggtgacaaaccggaggaaggtggggacgacgtcaagtcatcatggcccttacgacctgggctacacacgtgctacaatgggctgtacaaagggttgccaagccgcgaggtggagctaatcccataaaacagttcgtagtccggattggagtctgcaactcgactccatgaagtcggaatcgctagtaatcgtaaatcagaatgttacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccctaggggaacctggggctggatcacctccttaa

SEQ ID NO: 9636 - DNA, 1538 bp, Terracoccus luteus
  ref <308>: DATABASE ACCESSION NUMBER: NCBI ACCESSION: NZ_RBXT01000001.1
  ref <309>: DATABASE ENTRY DATE: 2019-04-01
  ref <313>: RELEVANT RESIDUES IN SEQ ID NO: (1)..(1538)
tcaacggagagtttgatcctggctcaggacgaacgctggcggcgtgcttaacacatgcaagtcgaacggtgatgatcaagcttgcttggtcggatcagtggcgaacgggtgagtaacacgtgagcaacctgccccagactctgggataacttcgggaaaccggagctaataccggatatgacactcgcacgcatgtgctgggtgtggaaagtttttcggtctgggatgggctcgcggcctatcagcttgttggtgaggtagtggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcaccggctaactacgtgccagcagccgcggtaatacgtagggtgcgagcgttgtccggaattattgggcgtaaagagcttgtaggtggtttgtcgcgtctgctgtgaaaatccggggctcaaccccggacttgcagtgggtacgggcagactagagtgtggtaggggagactggaattcctggtgtagcggtggaatgcgcagatatcaggaggaacaccgatggcgaaggcaggtctctgggccattactgacactgagaagcgaaagcatggggagcgaacaggattagataccctggtagtccatgccgtaaacgttgggaactaggtgtgggtctcattccacgagatccgtgccgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatacaccggacgcatccagagatgggtgttccttcgggctggtgtacaggtggtgcatggttgtcgtcagctcgtgtcgtgagatgttgggttaagtcccgcaacgagcgcaaccctcgttccatgttgccagcaacacttcggtggttggggactcatgggagactgccggggtcaactcggaggaaggtggggatgacgtcaaatcatcatgccccttatgtcttgggcttcacgcatgctacaatggccggtacaaagggctgcgaaaccgcgaggtggagcgaatcccaaaaaaccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaactgccttgtgcagggggagccgtcgaaggtgggactggcgattgggactaagtcgtaacaaggtagccgtaccggaaggtgcggctggatcacctcctttctaagga

SEQ ID NO: 9637 - DNA, 1566 bp, Terribacillus halophilus
  ref <308>: DATABASE ACCESSION NUMBER: NCBI ACCESSION: NZ_LT727824.1
  ref <309>: DATABASE ENTRY DATE: 2019-04-01
  ref <313>: RELEVANT RESIDUES IN SEQ ID NO: (1)..(1566)
ttcatggagagtttgatcttggctcaggacgaacgctggcggcgtgcctaatacatgcaagtcgagcgcaggaagctagatgaccccttcggggtgattctagtggaatgagcggcggacgggtgagtaacacgtgggcaacctgcctgtaagactgggataactccgggaaaccggggctaataccggatagtattttctttctcctgattgaaaatggaaagacggtttcggctgtcacttacagatgggcccgcggtgcattagctagttggtggggtaatggcccaccaaggcgacgatgcatagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgtcagggaagaacaagtacgagagtaactgctcgtaccttgacggtacctgaccagaaagccccggctaactacgtgccagcagccgcggtaatacgtagggggcaagcgttgtccggaattattgggcgtaaagggcgtgtaggcggtttcttaagtctgatgtgaaagcccacagcttaactgtggagggtcattggaaactggggaacttgagtgcagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatccgctgacaaccttggagacaaggcattcccttcggggacagcgtgacaggtggtgcatggttgtcgtcagctcgtgtcgtgagatgttgggttaagtcccgcaacgagcgcaacccttgattctagttgccagcattcagttgggcactctagagtgactgccggtgacaaaccggaggaaggtggggatgacgtcaaatcatcatgccccttatgacctgggctacacacgtgctacaatggatggtacaaagggcagcaagaccgcgaggttaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgccgaaggtgggatcaatgattggggtgaagtcgtaacaaggtagccgtatcggaaggtgcggctggatcacctcctttctaa

SEQ ID NO: 9638 - DNA, 248 bp, Terrisporobacter glycolicus
  ref <308>: DATABASE ACCESSION NUMBER: NCBI ACCESSION: NZ_FORW01000014.1
  ref <309>: DATABASE ENTRY DATE: 2019-04-01
  ref <313>: RELEVANT RESIDUES IN SEQ ID NO: (1)..(248)
ttttttatgagagtttgatcctggctcaggatgaacgctggcggcgtgcctaacacatgcaagtcgagcgatttacttcggtaaagagcggcggacgggtgagtaacgcgtgggtaacctgcctcatacacatggataacataccgaaaggtatgctaatacaggataatataagagattcacatggatttcttatcaaagctccggcggtatgagatggacccgcgtctgattagctagttggtaag

SEQ ID NO: 9639 - DNA, 1432 bp, Terrisporobacter othiniensis
  ref <308>: DATABASE ACCESSION NUMBER: NCBI ACCESSION: NZ_JWHR01000141.1
  ref <309>: DATABASE ENTRY DATE: 2019-04-01
  ref <313>: RELEVANT RESIDUES IN SEQ ID NO: (1)..(1432)
gaagagcggcggacgggtgagtaacgcgtgggtaacctgcctcatacacatggataacataccgaaaggtatgctaatacaggataacataagagattcgcatgtttctcttatcaaagctccggcggtatgagatggacccgcgtctgattagctagttggtaaggtaatggcttaccaaggcaacgatcagtagccgacctgagagggtgatcggccacattggaactgagacacggtccaaactcctacgggaggcagcagtggggaatattgcacaatgggcgaaagcctgatgcagcaacgccgcgtgagtgatgaaggccttcgggtcgtaaaactctgtcctcaaggaagataatgacggtacttgaggaggaagccccggctaactacgtgccagcagccgcggtaatacgtagggggctagcgttatccggatttactgggcgtaaagggtgcgtaggtggtttcttaagtcaggagtgaaaggctacggcttaaccgtagtaagctcttgaaactgggaaacttgagtgcaggagaggaaagtggaattcctagtgtagcggtgaaatgcgtagatattaggaggaacaccagtagcgaaggcggctttctggactgtaactgacactgaggcacgaaagcgtggggagcaaacaggattagataccctggtagtccacgccgtaaacgatgagtactaggtgtcgggggttacccccctcggtgccgcagctaacgcattaagtactccgcctggggagtacgctcgcaagagtgaaactcaaaggaattgacggggacccgcacaagtagcggagcatgtggtttaattcgaagcaacgcgaagaaccttacctaagcttgacatccttttgaccgatgcctaatcgcatttttcccttcggggacagaagtgacaggtggtgcatggttgtcgtcagctcgtgtcgtgagatgttgggttaagtcccgcaacgagcgcaacccttgcctttagttgccagcattaagttgggcactctagagggactgccagggataacctggaggaaggtggggatgacgtcaaatcatcatgccccttatgcttagggctacacacgtgctacaatgggtggtacagagggcagccaagtcgtgaggccgagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccacggaagttgggggcgcccgaagccacttagctaacccttttgggaagcgagtgtcgaaggtgaaatcaataactggggtgaagtcgtaacaaggtagccgtatcggaaggtgcggctggatcacctcctttctaggga

SEQ ID NO: 9640 - DNA, 1534 bp, Tessaracoccus sp. JDX10
  ref <308>: DATABASE ACCESSION NUMBER: NCBI ACCESSION: NZ_REFW01000009.1
  ref <309>: DATABASE ENTRY DATE: 2019-04-01
  ref <313>: RELEVANT RESIDUES IN SEQ ID NO: (1)..(1534)
ttttcaacggagagtttgatcctggctcaggacgaacgctggcggcgtgcttaacacatgcaagtcgaacggtaaggccccttcgggggtacacgagtggcgaacgggtgagtaacacgtgagtaacctacccttgactctgggataacagttggaaacagctgctaataccggatattcaacctctgaggcatcttcggggttggaaagttctggcggtcaaggatggactcgcggcctatcagcttgttggtgaggtaatggctcaccaaggcttcgacgggtagccggcctgagagggcgaccggccacattgggactgagatacggcccaaactcctacgggaggcagcagtggggaatattgcacaatgggcgaaagcctgatgcagcaacgccgcgtgcgggatgacggccttcgggttgtaaaccgctttcacccatgacgaagctttttgtgacggtagtgggagaagaagcaccggctaactacgtgccagcagccgcggtgatacgtagggtgcgagcgttgtccggatttattgggcgtaaagagcttgtaggcggtttgtcacgtcgggagtgaaaactcagggcttaaccctgagcctgcttccgatacgggcagacttgaggaaggtaggggagaatggaattcctggtggagcggtggaatgcgcagatatcaggaggaacaccagtggcgaaggcggttctctggacctttcctgacgctgagaagcgaaagcgtggggagcaaacaggcttagataccctggtagtccacgccgtaaacggtgggtactaggtgtgggggacattccacgttctccgtgccgcagctaacgcattaagtaccccgcctggggagtacggccgcaaggctaaaactcaaaggaattgacggggccccgcacaagcggcggagcatgcggattaattcgatgcaacgcgaagaaccttacctgggtttgacatatgccggaaacatccagagatggatgcccctttatggtcggtttacaggtggtgcatggctgtcgtcagctcgtgtcgtgagatgttgggttaagtcccgcaacgagcgcaaccctcgtccaatgttgccagcgggtaatgccggggactcattggagaccgccggggtcaactcggaggaaggtggggatgacgtcaagtcatcatgccccttatgtccagggcttcacgcatgctacaatggccggtacaaagggctgcaaacctgcaagggtgagcgaatcccaaaaagccggtctcagttcggattggggtctgcaactcgaccccatgaagtcggagtcgctagtaatcgcagatcagcaacgctgcggtgaatacgttcccggggcttgtacacaccgcccgtcaagtcatgaaagtcggtaacacccgaagccggtggcctaaccccttgtgggagggagccgtcgaaggtgggaccggtaattaggactaagtcgtaacaaggtagccgtaccggaaggtgcggctggatcacctcctttctaaggag

SEQ ID NO: 9641 - DNA, 1532 bp, Tessaracoccus sp. OH4464 COT-324
  ref <308>: DATABASE ACCESSION NUMBER: NCBI ACCESSION: NZ_RQYZ01000036.1
  ref <309>: DATABASE ENTRY DATE: 2019-04-01
  ref <313>: RELEVANT RESIDUES IN SEQ ID NO: (1)..(1532)
tttttaacggagagtttgatcctggctcaggacgaacgctggcggcgtgcttaacacatgcaagtcgaacggtaaggcccttttgggggtacacgagtggcgaacgggtgagtaacacgtgagtaacctgcccttgactctgggataacagttggaaacagttgctaataccggatatgaacccctggggcatcttgggggttggaaagttccggcggtcagggatgggctcgcggcctatcagcttgttggtgaggtagtggctcaccaaggcgacgacgggtagccggcctgagagggcgaccggccacattgggactgagatacggcccaaactcctacgggaggcagcagtggggaatattgcacaatgggcggaagcctgatgcagcaacgccgcgtgcgggatgacggccttcgggttgtaaaccgctttcatccatgacgaagcttttgtgacggtagtgggagaagaagcaccggctaactacgtgccagcagccgcggtgatacgtagggtgcgagcgttgtccggaattattgggcgtaaagagcttgtaggcggtttgtcgcgtcggtagtgaaaactcggggcttaactctgagcttgcttccgatacgggctgacttgagggaggtaggggagaatggaattcctggtgaagcggtggaatgcgtagatatcaggaggaacaccggtggcgaaggcggttctctggacctttcctgacgctgagaagcgaaagcgtggggagcgaacaggcttagataccctggtagtccacgctgtaaacggtgggtactaggtgtgggggacattccacgttctccgtgccgtagctaacgcattaagtaccccgcctggggagtacggccgcaaggctaaaactcaaaggaattgacggggccccgcacaagcggcggagcatgcggattaattcgatgcaacgcgaagaaccttacctgggtttgacatatgccggatgcgtctagagatgggcgttccctttttgggtcggtttacaggtggtgcatggctgtcgtcagctcgtgtcgtgagatgttgggttaagtcccgcaacgagcgcaaccctcgtcctatgttgccagcgggttatgccggggactcatgggagaccgccggggtcaactcggaggaaggtggggatgacgtcaagtcatcatgccccttatgtccagggcttcacgcatgctacaatggccggtacaaagagttgcgagtctgtaagggtgagcgaatctcaaaaagccggtctcagttcggattggggtctgcaactcgaccccatgaagtcggagtcgctagtaatcgcagatcagcaacgctgcggtgaatacgttcccggggcttgtacacaccgcccgtcaagtcatgaaagtcggtaacacccgaagccagtggcctaacctttttggggggagctgtcgaaggtgggactggtaattaggactaagtcgtaacaaggtagccgtaccggaaggtgcggctggatcacctcctttctaaggag

SEQ ID NO: 9642 - DNA, 1563 bp, Tetragenococcus halophilus
  ref <308>: DATABASE ACCESSION NUMBER: NCBI ACCESSION: NZ_PXYA01000002.1
  ref <309>: DATABASE ENTRY DATE: 2019-04-01
  ref <313>: RELEVANT RESIDUES IN SEQ ID NO: (1)..(1563)
atgagagtttgatcctggctcaggacgaacgctggcggcgtgcctaatacatgcaagtcgaacgctgcttaagaagaaacttcggttttttcttaagcggagtggcggacgggtgagtaacacgtggggaacctatctatcagcgggggataacacttggaaacaggtgctaataccgcatatggctttttttcacctgaaagaaagctcaaaggcgctttacagcgtcactgatggctggtcccgcggtgcattagccagttggtgaggtaacggctcaccaaagcaacgatgcatagccgacctgagagggtgatcggccacactgggactgagacacggcccagactcctacgggaggcagcagtagggaatcttcggcaatggacgcaagtctgaccgagcaacgccgcgtgagtgaagaaggttttcggatcgtaaagctctgttgtcagcaaagaacaggagaaagaggaaatgctttttctatgacggtagctgaccagaaagccacggctaactacgtgccagcagccgcggtaatacgtaggtggcaagcgttgtccggatttattgggcgtaaagcgagcgcaggcggtgatttaagtctgatgtgaaagcccccagctcaactggggagggtcattggaaactggatcacttgagtgcagaagaggagagtggaattccatgtgtagcggtgaaatgcgtagatatatggaggaacaccagtggcgaaggcggctctctggtctgtaactgacgctgaggctcgaaagcgtgggtagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccgccctagagatagggtttccccttcgggggcaaagtgacaggtggtgcatggttgtcgtcagctcgtgtcgtgagatgttgggttaagtcccgtaacgagcgcaacccttattgttagttgccagcattgagttgggcactctagcaagactgccggtgacaaaccggaggaaggcggggatgacgtcaaatcatcatgccccttatgacctgggctacacacgtgctacaatgggaagtacaacgagcaagccaagccgcaaggcctagcgaatctctgaaagcttctctcagttcggattgcaggctgcaactcgcctgcatgaagccggaatcgctagtaatcgcggatcagcatgccgcggtgaatccgttcccgggccttgtacacaccgcccgtcacaccacgagagtttgtaacacccaaagtcggtgcggcaacccttcggggagccagccgcctaaggtgggacgaatgattggggtgaagtcgtaacaaggtagccgtatcggaaggtgcggctggatcacctcctttctaaggaa

SEQ ID NO: 9643 - DNA, 1563 bp, Tetragenococcus koreensis
  ref <308>: DATABASE ACCESSION NUMBER: NCBI ACCESSION: NZ_CP027786.1
  ref <309>: DATABASE ENTRY DATE: 2019-04-01
  ref <313>: RELEVANT RESIDUES IN SEQ ID NO: (1)..(1563)
tgagagtttgatcctggctcaggacgaacgctggcggcgtgcctaatacatgcaagtcgaacgctgcttcgatcgaaacttcggtttcttttgaagcggagtggcggacgggtgagtaacacgtggggaacctatccatcagcgggggataacacttggaaacaggtgctaataccgcataaggctttctttcgcctgaaagaaagctaaaaggcgctttttgcgtcactgatggctggtcccgcggtgcattagccagttggtgaggtaacggctcaccaaagcaacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaagctctgttgtcagtaaagaacaggaaaaagaggcaatgctttttctatgacggtagctgaccagaaagccacggctaactacgtgccagcagccgcggtaatacgtaggtggcaagcgttgtccggatttattgggcgtaaagcgagcgcaggcggtgatttaagtctgatgtgaaagcccccggctcaaccggggagggtcattggaaactggatcacttgagtgcagaagaggagagtggaattccatgtgtagcggtgaaatgcgtagatatatggaggaacaccagtggcgaaggcggctctctggtctgtaactgacgctgaggctcgaaagcgtgggtagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccacgcgagagatcgcgtttccccttcgggggcaaagtgacaggtggtgcatggttgtcgtcagctcgtgtcgtgagatgttgggttaagtcccgcaacgagcgcaacccttattgttagttgccagcattcagttgggcactctagcaagactgccggtgacaaaccggaggaaggtggggatgacgtcaaatcatcatgccccttatgacctgggctacacacgtgctacaatgggaagtacaacgagcaagccaagccgcaaggccgcgcgaatctctgaaagcttctctcagttcggattgcaggctgcaactcgcctgcatgaagccggaatcgctagtaatcgcggatcagcatgccgcggtgaatccgttcccgggccttgtacacaccgcccgtcacaccacgagagtttgtaacacccaaagtcggtgcggcaacctcattagaggagccagccgcctaaggtgggatgaatgattggggtgaagtcgtaacaaggtagccgtatcggaaggtgcggctggatcacctcctttctaaggaa

SEQ ID NO: 9644 - DNA, 1559 bp, Tetragenococcus muriaticus
  ref <308>: DATABASE ACCESSION NUMBER: NCBI ACCESSION: NZ_JPVT01000250.1
  ref <309>: DATABASE ENTRY DATE: 2019-04-01
  ref <313>: RELEVANT RESIDUES IN SEQ ID NO: (1)..(1559)
tgagagtttgatcctggctcaggacgaacgctggcggcgtgcctaatacatgcaagtcgaacgctgcccctgttccccttcgggggaagaggtggcagagtggcggacgggtgagtaacacgtggggaacctacccagcagcgggggataacacttggaaacaggtgctaataccgcataagcctttttttccacctggaagaaagggaaaaggcgctttaagcgtcactgctggaggggcccgcggtgcattagccagttggtgaggtaacggctcaccaaagcaacgatgcatagccgacctgagagggtgatcggccacactgggactgagacacggcccagactcctacgggaggcagcagtagggaatcttcggcaatggacgcaagtctgaccgagcaacgccgcgtgagtgaagaaggttttcggatcgtaaagctctgttgtcagccaagaacaggaagaagagggaatgctttttctatgacggtagctgaccagaaagccacggctaactacgtgccagcagccgcggtaatacgtaggtggcaagcgttgtccggatttattgggcgtaaagggagcgcaggcggttcgttaagtctgatgtgaaagccctcggctcaaccgaggaggggcattggaaactggcgaacttgagtacagaagaggagagtggaattccatgtgtagcggtgaaatgcgtagatatatggaggaacaccggtggcgaaggcgactctctggtctgtgactgacgctgaggctcgaaagcgtgggtagcaaacaggattagataccctggtagtccacgccgtaaacgctgagtgctaagtgttggagggtttccgcccttcagtgctgcagttaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccgccctagagatagggtttccccttcgggggcaaagagacaggtggtgcatggttgtcgtcagctcgtgtcgtgagatgttgggttaagtcccgtaacgagcgcaacccttatggctagttgccagcattcagttgggcactctagtcagactgccggtgacaaaccggaggaaggtggggatgacgtcaaatcatcatgccccttatgacctgggctacacacgtgctacaatggggagtacaacgagcgcgcgaagccgcaaggcccagcgaatctctgaaagcttctctcagttcggattgcaggctgcaactcgcctgcatgaagccggaatcgctagtaatcgcggatcagcatgccgcggtgaatccgttcccgggccttgtacacaccgcccgtcacaccacgagagttcgtaacacccgaagtcggtgaggtaaccgcaaggagcctactgccgaaggtgggacgaacgattggggtgaagtcgtaacaaggtagccgtatcggaaggtgcggctggatcacctcctttctaaggaa

SEQ ID NO: 9645 - DNA, 1558 bp, Tetragenococcus osmophilus
  ref <308>: DATABASE ACCESSION NUMBER: NCBI ACCESSION: NZ_CP027783.1
  ref <309>: DATABASE ENTRY DATE: 2019-04-01
  ref <313>: RELEVANT RESIDUES IN SEQ ID NO: (1)..(1558)
tgagagtttgatcctggctcaggacgaacgctggcggcgtgcctaatacatgcaagtcgaacgctgcaccttttcaacttcggttgaaaaggctgcggagtggcggacgggtgagtaacacgtggggaacctacccagcagcgggggataacacttggaaacaggtgctaataccgcataggactttttttcgcctgaaaggaagttaaaagacgctttttgcgtcactgctggagggacccgcggtgcattagccagttggtgaggtaacggctcaccaaagcaacgatgcatagccgacctgagagggtgatcggccacactgggactgagacacggcccagactcctacgggaggcagcagtagggaatcttcggcaatggacgcaagtctgaccgagcaacgccgcgtgagtgaagaaggttttcggatcgtaaagctctgttgtcagccaagaacaggaaaaagaggcaatgctttttctttgacggtagctgaccagaaagccacggctaactacgtgccagcagccgcggtaatacgtaggtggcaagcgttgtccggatttattgggcgtaaagggagcgcaggcggttcgttaagtctgatgtgaaagccctcggctcaaccgaggagggtcattggaaactggcgaacttgagtgcagaagaggagagtggaattccatgtgtagcggtgaaatgcgtagatatatggaggaacaccggtggcgaaggcgactctctggtctgtaactgacgctgaggctcgaaagtgtgggtagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgtccgccctagagatagggcttccccttcgggggcaaagtgacaggtggtgcatggttgtcgtcagctcgtgtcgtgagatgttgggttaagtcccgtaacgagcgcaacccttatggctagttgccagcatttagttgggcactctagtcagactgccggtgacaaaccggaggaaggtggggatgacgtcaaatcatcatgccccttatgacctgggctacacacgtgctacaatgggaagtacaacgagcgcgccaagccgtaaggccgagcgaatctctgaaagcttctctcagttcggattgcaggctgcaactcgcctgcatgaagccggaatcgctagtaatcgcggatcagcatgccgcggtgaatccgttcccgggccttgtacacaccgcccgtcacaccacgagagttcgtaacacccgaagtcggtgaggtaaccgcaaggagcctgccgccgaaggtgggacgaacgattggggtgaagtcgtaacaaggtagccgtatcggaaggtgcggctggatcacctcctttctaaggaa

SEQ ID NO: 9646 - DNA, 1059 bp, Tetragenococcus solitarius
  ref <308>: DATABASE ACCESSION NUMBER: NCBI ACCESSION: NZ_BCPY01000085.1
  ref <309>: DATABASE ENTRY DATE: 2019-04-01
  ref <313>: RELEVANT RESIDUES IN SEQ ID NO: (1)..(1059)
agaaagccacggctaactacgtgccagcagccgcggtaatacgtaggtggcaagcgttgtccggatttattgggcgtaaagcgagcgcaggcggtgatgtaagtctgatgtgaaagcccccggctcaaccggggagggtcattggaaactggatcacttgagtgcagaagaggagagtggaattccatgtgtagcggtgaaatgcgtagatatatggaggaacaccagtggcgaaggcggctctctggtctgtgactgacgctgaggctcgaaagcgtgggtagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccgcgtccgagaggacgtttccccttcgggggcaaagtgacaggtggtgcatggttgtcgtcagctcgtgtcgtgagatgttgggttaagtcccgtaacgagcgcaacccttattgttagttgccagcattgagttgggcactctagcaagactgccggtgacaaaccggaggaaggcggggatgacgtcaaatcatcatgccccttatgacctgggctacacacgtgctacaatgggaagtacaacgagcgcgccaagccgcaaggccgagcgaatctctgaaagcttctctcagttcggattgcaggctgcaactcgcctgcatgaagccggaatcgctagtaatcgcggatcagcatgccgcggtgaatccgttcccgggccttgtacacaccgcccgtcacaccacgagagtttgtaacacccaaagtcggtgcggcaacccttcggggagccagccgcctaaggtgggatgaatgattggggtgaagtcgtaacaaggtagccgtatcggaaggtgcggctggatcacctcctttctaaggaa

SEQ ID NO: 9647 - DNA, 1555 bp, Tetzosporium hominis
  ref <308>: DATABASE ACCESSION NUMBER: NCBI ACCESSION: NZ_NOKQ01000284.1
  ref <309>: DATABASE ENTRY DATE: 2019-04-01
  ref <313>: RELEVANT RESIDUES IN SEQ ID NO: (1)..(1555)
ttatggagagtttgatcctggctcaggacgaacgctggcggcgtgcctaatacatgcaagtcgagcggatgacagaggagcttgctcctctagattcagcggcggacgggtgagtaacacgtgggcaacctgccctgtagattgggataactccgggaaaccggggctaataccgaataatccttcggacctcatggtccgatgttgaaaggcggcatctcgctgtcactacaggatgggcccgcggcgcattagctagttggtgaggtaacggctcaccaaggccacgatgcgtagccgacctgagagggtgatcggccacactgggactgagacacggcccagactcctacgggaggcagcagtagggaatcttccacaatggacgaaagtctgatggagcaacgccgcgtgagtgaagaaggttctcggatcgtaaaactctgttgtgagggaagaacaagtaccggagtaactgccggtaccttgacggtacctcattagaaagccacggctaactacgtgccagcagccgcggtaatacgtaggtggcaagcgttgtccggaatcattgggcgtaaagcgcgcgcaggcggtcccttaagtctgatgtgaaagcccacggctcaaccgtggagggtcattggaaactgggggacttgagtgcagaagaggaaagcggaattccaagtgtagcggtgaaatgcgtagagatttggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgccgaccgcctaggagactaggccttcccttcggggacggcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcgaacccgcgagggggagccaatcccataaaaccattctcagttcggattgtaggctgcaactcgcctacatgaagctggaatcgctagtaatcgtggatcagcatgccacggtgaatacgttcccgggccttgtacacaccgcccgtcacaccacgagagtttgtaacacccgaagtcggtggggtaacctttatggagccagccgccgaaggtgggacagatgattggggtgaagtcgtaacaaggtagccgtatcggaaggtgcggctggatcacctcctttct

SEQ ID NO: 9648 - DNA, 1570 bp, Thalassobacillus devorans
  ref <308>: DATABASE ACCESSION NUMBER: NCBI ACCESSION: NZ_FXEH01000005.1
  ref <309>: DATABASE ENTRY DATE: 2019-04-01
  ref <313>: RELEVANT RESIDUES IN SEQ ID NO: (1)..(1570)
tttatggagagtttgatcctggctcaggacgaacgctggcggcgtgcctaatacatgcaagtcgagcgcgggaagcaagcggatccccttcgggggtgacgcttgtggaacgagcggcggacgggtgagtaacacgtgggcaacctgcctgtaagactgggataaccccgggaaaccggggctaataccggataacaccggactccacatggagtcgggttgaaagatggcttctcgctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgtcagggaagaacaagtgccgtgcgaatagagcggcaccttgacggtacctgacgaggaagccccggctaactacgtgccagcagccgcggtaatacgtagggggcaagcgttgtccggaattattgggcgtaaagcgcgcgcaggcggttccttaagtctgatgtgaaagcccacggctcaaccgtggagggtcattggaaactggggaacttgagtgcagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttagggggcttccaccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcttcggacaaccctggagacagggcgttcccttcggggaccgaatgacaggtggtgcatggttgtcgtcagctcgtgtcgtgagatgttgggttaagtcccgcaacgagcgcaacccctgaccttagttgccagcattcagttgggcactctaaggtgactgccggtgacaaaccggaggaaggcggggatgacgtcaaatcatcatgccccttatgacctgggctacacacgtgctacaatggatggtacaaagggcagcgaagccgcgaggtgtagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaacctttatggagccagccgccgaaggtggggccaatgattggggtgaagtcgtaacaaggtagccgtatcggaaggtgcggctggatcacctcctttcta

SEQ ID NO: 9649 - DNA, 1570 bp, Thalassobacillus sp. TM-1
  ref <308>: DATABASE ACCESSION NUMBER: NCBI ACCESSION: NZ_CTEA01000005.1
  ref <309>: DATABASE ENTRY DATE: 2019-04-01
  ref <313>: RELEVANT RESIDUES IN SEQ ID NO: (1)..(1570)
tttatggagagtttgatcctggctcaggacgaacgctggcggcgtgcctaatacatgcaagtcgagcgcgggaagcaagcggatccccttcgggggtgacgcttgtggaacgagcggcggacgggtgagtaacacgtgggcaacctgcctgtaagactgggataaccccgggaaaccggggctaataccggataacaccggactccacatggagtcgggttgaaagatggcttctggctatcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggtcttcggatcgtaaagttctgttgtcagggaagaacaagtgccgtgcgaatagagcggcaccttgacggtacctgacgaggaagccccggctaactacgtgccagcagccgcggtaatacgtagggggcaagcgttgtccggaattattgggcgtaaagcgcgcgcaggcggttccttaagtctgatgtgaaagcccacggctcaaccgtggagggtcattggaaactggggaacttgagtacagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttagggggcttccaccccttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcttcggacacccctggagacagggcgttcccttcggggaccgaatgacaggtggtgcatggttgtcgtcagctcgtgtcgtgagatgttgggttaagtcccgcaacgagcgcaacccctgaccttagttgccagcattcagttgggcactctaaggtgactgccggtgacaaaccggaggaaggcggggatgacgtcaaatcatcatgccccttatgacctgggctacacacgtgctacaatggatggtacaaagggcagcgaagccgcgaggtgtagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaacctttatggagccagccgccgaaggtggggccaatgattggggtgaagtcgtaacaaggtagccgtatcggaaggtgcggctggatcacctcctttcta

SEQ ID NO: 9650 - DNA, 1475 bp, Thalassobacter sp. 16PALIMAR09
  ref <308>: DATABASE ACCESSION NUMBER: NCBI ACCESSION: NZ_JHAK01000023.1
  ref <309>: DATABASE ENTRY DATE: 2019-04-01
  ref <313>: RELEVANT RESIDUES IN SEQ ID NO: (1)..(1475)
caacttgagagtttgatcctggctcagaacgaacgctggcggcaggcctaacacatgcaagtcgagcgcttcacttcggtgaggagcggcggacgggttagtaacgcgtgggaacatacccttctctaaggaatagccactggaaacggtgagtaataccttatacgcccttcgggggaaagatttatcggagaaggattggcccgcgttagattagatagttggtggggtaatggcctaccaagtctacgatctatagctggtttgagaggatgatcagcaacactgggactgagacacggcccagactcctacgggaggcagcagtggggaatcttagacaatgggcgcaagcctgatctagccatgccgcgtgagtgatgaaggccctagggtcgtaaagctctttcgccagagatgataatgacagtatctggtaaagaaaccccggctaactccgtgccagcagccgcggtaatacggagggggttagcgttgttcggaattactgggcgtaaagcgcgcgtaggcggactattaagttagaggtgaaatcccggggctcaaccccggaactgcctttaatactggtagtcttgagttcgagagaggtgagtggaattccaagtgtagaggtgaaattcgtagatatttggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctgctcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcatcgagatttctggagacagatttcgtcagttcggctggatgagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcaagtacagtgagttaatctccaaaacttgtctcagttcggattggggtctgcaactcgaccccatgaagtcggaatcgctagtaatcgcgtaacagcatgacgcggtgaatacgttcccgggccttgtacacaccgcccgtcacaccatgggagttgggtccacccgaaggccgtgcgccaacctgcttgcagggggcagcggaccacggtgagctcagcgactggggtgaagtcgtaacaaggtagccgtaggggaacctgcggctggatcacctcctttcta

SEQ ID NO: 9651 - DNA, 1007 bp, Thalassobacter stenotrophicus
  ref <308>: DATABASE ACCESSION NUMBER: NCBI ACCESSION: NZ_FQYZ01000039.1
  ref <309>: DATABASE ENTRY DATE: 2019-04-01
  ref <313>: RELEVANT RESIDUES IN SEQ ID NO: (1)..(1007)
ggggaatcttagacaatgggcgcaagcctgatctagccatgccgcgtgagtgatgaaggccctagggtcgtaaagctctttcgccagagatgataatgacagtatctggtaaagaaaccccggctaactccgtgccagcagccgcggtaatacggagggggttagcgttgttcggaattactgggcgtaaagcgcgcgtaggcggactattaagttagaggtgaaatcccagggctcaaccctggaactgcctttaatactggtagtcttgagttcgagagaggtgagtggaattccaagtgtagaggtgaaattcgtagatatttggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctgctcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcatcgagatttctggagacagatttcgtcagttcggctggatgagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcaagtacagtgagttaatctccaaaacttgtctcagttcggattggggtctgcaactcgaccccatgaagtcggaatcgctagtaatcgcgtaacagcatgacgcggtgaatacgttcccgggccttgtacacaccgcccgtcac

SEQ ID NO: 9652 - DNA, 1493 bp, Thalassobaculum litoreum
  ref <308>: DATABASE ACCESSION NUMBER: NCBI ACCESSION: NZ_FNBW01000011.1
  ref <309>: DATABASE ENTRY DATE: 2019-04-01
  ref <313>: RELEVANT RESIDUES IN SEQ ID NO: (1)..(1493)
tcaacctgagagtttgatcctggctcagaacgaacgctggcggcatgcctaacacatgcaagtcgaacggctcttcggagcagtggcgcacgggtgagtaacgcgtgggaacctacctcgaggtacggaataacggctggaaacggccgctaataccgtatgtgtcctaagggagaaagatttatcgccttgagaggggcccgcgtccgattagcttgttggtgaggtaatggctcaccaaggcagtgatcggtagctggtctgagaggatgatcagccacactgggactgagacacggcccagactcctacgggaggcagcagtggggaatattggacaatgggcgaaagcctgatccagcaatgccgcgtgtgtgatgaaggccttagggttgtaaagcactttcgccgatgacgatgatgacggtagtcggataagaagccccggctaactccgtgccagcagccgcggtaatacggagggggcgagcgttgttcggaattactgggcgtaaagggcgcgtaggcggccatgtcagttgggagtgaaagccccgggctcaacctgggaactgctctcaatactgcgtggcttgagaacgggagagggtagtggaattcccagtgtagaggtgaaattcgtagatattgggaagaacaccagtggcgaaggcggctgcctggcccgtttctgacgctgaggcgcgaaagcgtggggagcaaacaggattagataccctggtagtccacgccgtaaacgatgagtgctagacgtcgggggacatgtccttcggtgtcgccgctaacgcattaagcactccgcctggggagtacggccgcaaggttaaaactcaaaggaattgacgggggcccgcacaagcggtggagcatgtggtttaattcgaagcaacgcgcagaaccttaccagcccttgacatgggaagtttggttaccggagacggtatccttcagttcggctggcttccgcacaggtgctgcatggctgtcgtcagctcgtgtcgtgagatgttgggttaagtcccgcaacgagcgcaacccttactgtcagttgccatcggttaggccgggcactctggcggaactgcctgtgacaagcaggaggaaggcggggatgacgtcaagtcctcatggcccttatgggctgggctacacacgtgctacaatggcggtgacaatgggcagcgaaggggcgacctggagcgaatccccaaaagccgtctcagttcggattgtactctgcaactcgagtgcatgaaggtggaatcgctagtaatcgtggatcagcatgccacggtgaatacgttcccgggccttgtacacaccgcccgtcacaccatgggagttggctttacccgaagacggtgcgctaaccgcaaggaggcagccggccacggtaaggtcagcgactggggtgaagtcgtaacaaggtagccgtaggggaacctgcggctggatcacctcctttctaagga

SEQ ID NO: 9653 - DNA, 1492 bp, Thalassobaculum salexigens
  ref <308>: DATABASE ACCESSION NUMBER: NCBI ACCESSION: NZ_KE384093.1
  ref <309>: DATABASE ENTRY DATE: 2019-04-01
  ref <313>: RELEVANT RESIDUES IN SEQ ID NO: (1)..(1492)
tcaacctgagagtttgatcctggctcagaacgaacgctggcggcatgcctaacacatgcaagtcgaacggctcttcggagcagtggcgcacgggtgagtaacgcgtgggaacctacctcgaggtacggaataacggctggaaacggccgctaataccgtatgtgtcctaagggagaaagatttatcgccttgagaggggcccgcgtccgattagcttgttggtgaggtaatggctcaccaaggcagtgatcggtagctggtctgagaggatgatcagccacactgggactgagacacggcccagactcctacgggaggcagcagtggggaatattggacaatgggcgaaagcctgatccagcaatgccgcgtgtgtgatgaaggccttagggttgtaaagcactttcgccgatgacgatgatgacggtagtcggataagaagccccggctaactccgtgccagcagccgcggtaatacggagggggcgagcgttgttcggaattactgggcgtaaagggcgcgtaggcggccatgtcagttgggagtgaaagccccgggctcaacctgggaactgctctcaatactgcgtggcttgagaacgggagagggtagtggaattcccagtgtagaggtgaaattcgtagatattgggaagaacaccagtggcgaaggcggctgcctggcccgtttctgacgctgaggcgcgaaagcgtggggagcaaacaggattagataccctggtagtccacgccgtaaacgatgagtgctagacgtcgggggacatgtccttcggtgtcgccgctaacgcattaagcactccgcctggggagtacggccgcaaggttaaaactcaaaggaattgacgggggcccgcacaagcggtggagcatgtggtttaattcgaagcaacgcgcagaaccttaccagcccttgacatgggaagtttggttaccggagacggtatccttcagttcggctggcttccgcacaggtgctgcatggctgtcgtcagctcgtgtcgtgagatgttgggttaagtcccgcaacgagcgcaacccttactgtcagttgccatcggttaggccgggcactctggcggaactgcctgtgacaagcaggaggaaggcggggatgacgtcaagtcctcatggcccttatgggctgggctacacacgtgctacaatggcggtgacaatgggcagcgaaggggcgacctggagcgaatccccaaaagccgtctcagttcggattgtactctgcaactcgagtgcatgaaggtggaatcgctagtaatcgtggatcagcatgccacggtgaatacgttcccgggccttgtacacaccgcccgtcacaccatgggagttggctttacccgaagacggtgcgctaaccgcaaggaggcagccggccacggtaaggtcagcgactggggtgaagtcgtaacaaggtagccgtaggggaacctgcggctggatcacctcctttctaagg

SEQ ID NO: 9654 - DNA, 1469 bp, Thalassobium sp. R2A62
  ref <308>: DATABASE ACCESSION NUMBER: NCBI ACCESSION: NZ_GG697169.2
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcacgcctaacacatgcaagtcgagcgctaccttcgggtggagcggcggacgggttagtaacgcgtgggaacataccctttactaaggaatagccactggaaacggtgagtaataccttatacgcccttcgggggaaagatttatcggtgaaggattggcccgcgttagattagatagttggtggggtaacggcctaccaagtctacgatctatagctggtttgagaggatgatcagcaacactgggactgagacacggcccagactcctacgggaggcagcagtggggaatcttagacaatgggcgcaagcctgatctagcgatgccgcgtgagtgacgaaggtcttaggatcgtaaagctctttcgccagggatgataatgacagtacctggtaaagaaaccccggctaactccgtgccagcagccgcggtaatacggagggggttagcgttgttcggaattactgggcgtaaagcgtacgtaggcggatcagaaagttgggggtgaaatcccagggctcaaccctggaactgcctccaaaactattggtctagagttcgagagaggtaagtggaattccgagtgtagaggtgaaattcgtagatattcggaggaacaccagtggcgaaggcggcttactggctcgatactgacgctgaggtacgaaagtgtggggagcaaacaggattagataccctggtagtccacaccgtaaacgatgaatgccagtcgtcagagggcttgccctttggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctatatccagagatggatagttcccttcggggacgcagtgacaggtgctgcatggctgtcgtcagctcgtgtcgtgagatgttcggttaagtccggcaacgagcgcaacccacatctttagttgccagcagttcggctgggcactctaaagaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggatctacccgaaggccgtgcgccaacctttcgagggggcagcggaccacggtgggttcagcgactggggtgaagtcgtaacaaggtagccgtaggggaacctgcggctggatcacctcctttctaa

SEQ ID NO: 9655 - DNA, 1465 bp, Thalassobius activus
  ref <308>: DATABASE ACCESSION NUMBER: NCBI ACCESSION: NZ_CYTO01000011.1
  ref <309>: DATABASE ENTRY DATE: 2019-04-01
  ref <313>: RELEVANT RESIDUES IN SEQ ID NO: (1)..(1465)
tcaacttgagagtttgatcctggctcagaacgaacgctggcggcaggcctaacacatgcaagtcgagcgccccttcgggggagcggcggacgggttagtaacgcgtgggaacgtgcccttctctaaggaatagccactggaaacggtgagtaataccttatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccctagggtcgtaaagctctttcgcctgtgaagataatgacggtagcaggtaaagaaaccccggctaactccgtgccagcagccgcggtaatacggagggggttagcgttgttcggaattactgggcgtaaagcgtacgtaggcggattagtcagtcagaggtgaaatcccagggctcaaccctggaactgcctttgatactgctagtcttgagttcgagagaggtaagtggaattccgagtgtagaggtgaaattcgtagatattcggaggaacaccagtggcgaaggcggcttactggctcgatactgacgctgaggtacgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatccagagatggatggttcccttcggggacgcagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaagctgtctcagttcggattgttctctgcaactcgagagcatgaagtcggaatcgctagtaatcgcgtaacagcatgacgcggtgaatacgttcccgggccttgtacacaccgcccgtcacaccatgggagttggttctacccgacggccgtgcgctaaccttttggaggcagcggaccacggtaggatcagcgactggggtgaagtcgtaacaaggtagccgtaggggaacctgcggctggatcacctcctttctaa

SEQ ID NO: 9656 - DNA, 1469 bp, Thalassobius autumnalis
  ref <308>: DATABASE ACCESSION NUMBER: NCBI ACCESSION: NZ_CYSC01000016.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcgcccttcggggtgagcggcggacgggttagtaacgcgtgggaatatgcccgacactaaggaatagcctctggaaacggagagtaataccttatacgcccttcgggggaaagatttatcggtgacggattagcccgcgttagattagatagttggtggggtaatggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggattagtcagttagaggtgaaatcccggggctcaaccccggaactgcctttaatactgctagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatccagagatggatggttcccttcggggacgcagtgacaggtgctgcatggctgtcgtcagctcgtgtcgtgagatgttcggttaagtccggcaacgagcgcaacccacatccttagttaccagcggttcggccgggaaccctaaggaaactgcccgtgataagcgggaggaaggtgtggatgacgtcaagtcctcatggcccttacgggttgggctacacacgtgctacaatggcagtgacaatgggttaatcccaaaaaactgtctcagttcggattgtcgtctgcaactcgacggcatgaagtcggaatcgctagtaatcgcgtaacagcatgacgcggtgaatacgttcccgggccttgtacacaccgcccgtcacaccatgggagttgggtttacccgaaggccgtgcgccaacctttcgagggggcagcggaccacggtgagctcagcgactggggtgaagtcgtaacaaggtagccctaggggaacctggggctggatcacctcctttctaa

SEQ ID NO: 9657 - DNA, 1469 bp, Thalassobius gelatinovorus
  ref <308>: DATABASE ACCESSION NUMBER: NCBI ACCESSION: NZ_FOFW01000024.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcttaacacatgcaagtcgagcgcacccttcggggtgagcggcggacgggttagtaacgcgtgggaacatacccttcactaaggaatagccactggaaacggtgagtaataccttatacgcccttcgggggaaagaatttcggtgagggattggcccgcgttagattagatagttggtggggtaatggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgcctgtgatgataatgacagtagcaggtaaagaaaccccggctaactccgtgccagcagccgcggtaatacggagggggttagcgttgttcggaattactgggcgtaaagcgcacgtaggcggactagtaagttagaggtgaaatcccagggctcaaccctggaactgcctttaatactgctagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctatatccagagatggatagttcctttcggggacgcagtgacaggtgctgcatggctgtcgtcagctcgtgtcgtgagatgttcggttaagtccggcaacgagcgcaacccacatccttagttgccagcaggttaagctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgccaacctttcgagggggcagcggaccacggtgagctcagcgactggggtgaagtcgtaacaaggtagccgtaggggaacctgcggctggatcacctcctttctaa

SEQ ID NO: 9658 - DNA, 1469 bp, Thalassobius mediterraneus
  ref <308>: DATABASE ACCESSION NUMBER: NCBI ACCESSION: NZ_FTNX01000020.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcgcccttcggggtgagcggcggacgggttagtaacgcgtgggaatatacccgacactaaggaatagcctctggaaacggagagtaataccttatacgcccttcgggggaaagatttatcggtgacggattagcccgcgttagattagatagttggtggggtaatggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagagatgataatgacagtatctggtaaagaaaccccggctaactccgtgccagcagccgcggtaatacggagggggttagcgttgttcggaattactgggcgtaaagcgcgcgtaggcggattagtcagttagaggtgaaatcccggggctcaaccccggaactgcctttaatactgctagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatccagagatggatggttcccttcggggacgcagtgacaggtgctgcatggctgtcgtcagctcgtgtcgtgagatgttcggttaagtccggcaacgagcgcaacccacatccttagttaccagcggttcggccgggaactctaaggaaactgcccgtgataagcgggaggaaggtgtggatgacgtcaagtcctcatggcccttacgggttgggctacacacgtgctacaatggcagtgacaatgggttaatcccaaaaaactgtctcagttcggattgtcgtctgcaactcgacggcatgaagtcggaatcgctagtaatcgcgtaacagcatgacgcggtgaatacgttcccgggccttgtacacaccgcccgtcacaccatgggagttgggtttacccgaaggccgtgcgccaacctttcgaggaggcagcggaccacggtgagctcagcgactggggtgaagtcgtaacaaggtagccctaggggaacctggggctggatcacctcctttctaa

SEQ ID NO: 9659 - DNA, 1471 bp, Thalassobius sp. I31.1
  ref <308>: DATABASE ACCESSION NUMBER: NCBI ACCESSION: NZ_PWAA01000046.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcacgcctaacacatgcaagtcgagcgctaccttcgggtggagcggcggacgggttagtaacgcgtgggaacataccctttactaaggaatagccactggaaacggtgagtaataccttatacgcccttcgggggaaagatttatcggtaaaggattggcccgcgttagattagatagttggtggggtaacggcctaccaagtcgacgatctatagctggtttgagaggatgatcagcaacactgggactgagacacggcccagactcctacgggaggcagcagtggggaatcttagacaatgggcgcaagcctgatctagcgatgccgcgtgagtgatgaaggccttagggtcgtaaagctctttcaccagggatgataatgacagtacctggaaaagaaaccccggctaactccgtgccagcagccgcggtaatacggagggggttagcgttgttcggaattactgggcgtaaagcgtacgtaggcggactagtaagttaggggtgaaatcccggggctcaaccccggaactgcctttaatactgctagtcttgagttcgagagaggtgagtggaattccgagtgtagaggtgaaattcgtagatattcggaggaacaccagtggcgaaggcggctcactggctcgatactgacgctgaggtacgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatacttgtcgcggttccagagatggaactttcagttcggctggacaagatacaggtgctgcatggctgtcgtcagctcgtgtcgtgagatgttcggttaagtccggcaacgagcgcaacccacgtccttagttgccagcaggttaagctgggcactctagggaaactgccggtgataagccggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaaggccgtgcgccaacctttcgagggggcagcggaccacggtgggctcagcgactggggtgaagtcgtaacaaggtagccctaggggaacctggggctggatcacctcctttctaa

SEQ ID NO: 9660 - DNA, 1469 bp, Thalassobius sp. ZQ172
  ref <308>: DATABASE ACCESSION NUMBER: NCBI ACCESSION: NZ_RYZK01000023.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcgcccttcggggtgagcggcggacgggttagtaacgcgtgggaacgtacctttcggtaaggaatagcctctggaaacggagagtaataccttatacgccctttgggggaaagatttatcgccgagggatcggcccgcgttagattagatagttggtggggtaatggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgtacgtaggcggaccattaagttgggggtgaaatcccagggctcaaccctggaactgcctccaaaactgctggtcttgagttcgagagaggtgagtggaattccgagtgtagaggtgaaattcgtagatattcggaggaacaccagtggcgaaggcggctcactggctcgatactgacgctgaggtacgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatccagagatggatggttcccttcggggacgcagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaacccttttgggaggcagcggaccacggtaggatcagcgactggggtgaagtcgtaacaaggtagccgtaggggaacctgcggctggatcacctcctttctaa

SEQ ID NO: 9661 - DNA, 1466 bp, Thalassococcus halodurans
  ref <308>: DATABASE ACCESSION NUMBER: NCBI ACCESSION: NZ_FNUZ01000011.1
  ref <309>: DATABASE ENTRY DATE: 2019-04-01
  ref <313>: RELEVANT RESIDUES IN SEQ ID NO: (1)..(1466)
tcaacttgagagtttgatcctggctcagaacgaacgctggcggcaggcctaacacatgcaagtcgagcgcaccttcgggtgagcggcggacgggttagtaacgcgtgggaacgtacccttttctaaggaatagccactggaaacggtgagtaataccttatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgctggggatgataatgacagtacccagtaaagaaaccccggctaactccgtgccagcagccgcggtaatacggagggggttagcgttgttcggaattactgggcgtaaagcgcgcgtaggcggattggaaagttgggggtgaaatcccggggctcaacctcggaactgcctccaaaactatcagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcagcaagcatgcttgttggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatccagagatggatggttcccttcggggacgcagtgacaggtgctgcatggctgtcgtcagctcgtgtcgtgagatgttcggttaagtccggcaacgagcgcaacccacatcttcagttgccagcagttcggctgggcactctggagaaactgcccgtgataagcgggaggaaggtgtggatgacgtcaagtcctcatggcccttacgggttgggctacacacgtgctacaatggcagtgacaatgggttaatccccaaaaactgtctcagttcggattgttctctgcaactcgagagcatgaagtcggaatcgctagtaatcgcgtaacagcatgacgcggtgaatacgttcccgggccttgtacacaccgcccgtcacaccatgggagttgggtttacccgaagacggtgcgccaaccttttaggaggcagctggccacggtaagctcagcgactggggtgaagtcgtaacaaggtagccgtaggggaacctgcggctggatcacctcctttctaa

SEQ ID NO: 9662 - DNA, 1469 bp, Thalassococcus sp. SH-1
  ref <308>: DATABASE ACCESSION NUMBER: NCBI ACCESSION: NZ_CP027665.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcgccttcgggtgagcggcggacgggttagtaacgcgtgggaacgtgcctctctctaaggaatagtctcgggaaactgagggtaataccttatacgcccttcgggggaaagatttatcggagagagatcggcccgcgttagattaggtagttggtggggtaacggcctaccaagcctacgatctatagctggttttagaggatgatcagcaacactgggactgagacacggcccagactcctacgggaggcagcagtggggaatcttggacaatgggcgcaagcctgatccagccatgccgcgtgagcgatgaaggccttagggttgtaaagctctttcgctggggaagataatgactgtacccagtaaagaagtcccggctaactccgtgccagcagccgcggtaatacggaggggactagcgttgttcggaattactgggcgtaaagcgcgcgtaggcggatcagcaagttaggggtgaaatcccggggctcaaccccggaactgcccttaaaactgttggtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatccagagatggatggttcccttcggggacgcagtgacaggtgctgcatggctgtcgtcagctcgtgtcgtgagatgttcggttaagtccggcaacgagcgcaacccacatctttagttgccagcagttcggctgggcactctaaagaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttgggttcacccgaaggccgtgcgccaacctcttcggagggggcagcggaccacggtgagctcagcgactggggtgaagtcgtaacaaggtagccgtaggggaacctgcggctggatcacctcctttctaa

SEQ ID NO: 9663 - DNA, 1469 bp, Thalassococcus sp. WRAS1
  ref <308>: DATABASE ACCESSION NUMBER: NCBI ACCESSION: NZ_QPMK01000001.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcaccttcgggtgagcggcggacgggttagtaacgcgtgggaacgtgcccttctctacggaatagcctcgggaaactgagagtaataccgtatacgcccttcgggggaaagatttatcggagaaggatcggcccgcgtctgattagatagttggtggggtaatggcctaccaagtctacgatcagtagctggttttagaggatgatcagcaacactgggactgagacacggcccagactcctacgggaggcagcagtggggaatcttagacaatgggcgaaagcctgatctagccatgccgcgtgagtgatgaaggccctagggtcgtaaagctctttcgctggggaagataatgactgtacccagtaaagaaaccccggctaactccgtgccagcagccgcggtaatacggagggggttagcgttgttcggaattactgggcgtaaagcgcgcgtaggcggattagaaagttaggggtgaaatcccggggctcaacctcggaactgcctctaaaactactagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatccagagatggatggttcccttcggggacgcagtgacaggtgctgcatggctgtcgtcagctcgtgtcgtgagatgttcggttaagtccggcaacgagcgcaacccacatctttagttgccagcagttcggctgggcactctagagaaactgcccgtgataagcgggaggaaggtgtggatgacgtcaagtcctcatggcccttacgggttgggctacacacgtgctacaatggtagtgacaatgggttaatcccaaaaagctatctcagttcggattgttctctgcaactcgagagcatgaagtcggaatcgctagtaatcgcgtaacagcatgacgcggtgaatacgttcccgggccttgtacacaccgcccgtcacaccatgggagttgggtttacccgaagacggtgcgccaacctgttcgcagggggcagctggccacggtaagctcagcgactggggtgaagtcgtaacaaggtagccgtaggggaacctgcggctggatcacctcctttctaa

SEQ ID NO: 9664 - DNA, 1544 bp, Thalassolituus oleivorans
  ref <308>: DATABASE ACCESSION NUMBER: NCBI ACCESSION: NZ_CP017810.1
  ref <309>: DATABASE ENTRY DATE: 2019-04-01
  ref <313>: RELEVANT RESIDUES IN SEQ ID NO: (1)..(1544)
aaactgaagagtttgatcatggctcagattgaacgctggcggcaggcttaacacatgcaagtcgagcggtagcacagagagcttgctctcgggtgacaagcggcggacgggtgagtaacgcgtaggaatctacctagtagtgggggacaacagttggaaacgactgctaataccgcatacgccctaagggggaaagcgggggatcttcggacctcgtgctattagatgagcctgcgtgagattagctagttggtgaggtaaaggctcaccaaggcgacgatctctagctggtctgagaggatgatcagccacactgggactgagacacggcccagactcctacgggaggcagcagtggggaatattggacaatgggcgcaagcctgatccagccatgccgcgtgtgtgaagaaggccttcgggttgtaaagcactttcagaagggaggaaaggttgtgtgttaatagcacatagctgtgacgttaccttcagaagaagcaccggctaactccgtgccagcagccgcggtaatacggagggtgcaagcgttaatcggaattactgggcgtaaagcgcgcgtaggttgtttgttaagcgagatgtgaaagccccgggcttaacctgggaactgcatttcgaactggcaagctagagtacagtagagggtagtggaatttcctgtgtagcggtgaaatgcgtagagatgggaaggaacatcagtggcgaaggcgactgcctggactgatactgacactgaggtgcgaaagcgtggggagcaaacaggattagataccctggtagtccacgccgtaaacgatgtctactagttgtcgggagacttgatctcttggtaacgaagctaacgcgataagtagaccgcctggggagtacggccgcaaggttaaaactcaaatgaattgacgggggcccgcacaagcggtggagcatgtggtttaattcgaagcaacgcgaagaaccttacctactcttgacatccagtgaacttagcagagatgctttggtgccttcgggaacactgagacaggtgctgcatggctgtcgtcagctcgtgttgtgaaatgttgggttaagtcccgtaacgagcgcaacccttgtccttagttaccatcattaagttggggactctaaggagactgccggtgacaaaccggaggaaggcggggacgacgtcaagtcatcatggcccttacgagtagggctacacacgtgctacaatggccagtacagagggttgcaataccgcgaggtggagctaatcccacaaagctggtcgtagtccggattggagtctgcaactcgactccatgaagtcggaatcgctagtaatcgtgaatcagaatgtcacggtgaatacgttcccgggccttgtacacaccgcccgtcacaccatgggagtgggttgctccagaagtagatagcctaaccttcgggagggcgtttaccacggagtgattcatgactggggtgaagtcgtaacaaggtagccctaggggaacctggggctggatcacctccttaaacga

SEQ ID NO: 9665 - DNA, 1179 bp, Thalassospira alkalitolerans
  ref <308>: DATABASE ACCESSION NUMBER: NCBI ACCESSION: NZ_JFKB01000041.1
  ref <309>: DATABASE ENTRY DATE: 2019-04-01
  ref <313>: RELEVANT RESIDUES IN SEQ ID NO: (1)..(1179)
ggcagcagtggggaatattggacaatgggcgcaagcctgatccagccatgccgcgtgagtgaagaaggccttcgggttgtaaagctctttcagatgtgaagatgatgacggtagcatcagaagaagccccggctaatttcgtgccagcagccgcggtaatacgaaaggggcaagcgttgttcggatttactgggcgtaaagggcacgcaggcggtcttgccagtcaggggtgaaagcccggggctcaaccccggaactgcctctgatactgcaggactagagactaggagagggtggtggaattcccagtgtagaggtgaaattcgtagatattgggaggaacaccagaggcgaaggcggccacctggactagatctgacgctcaggtgcgaaagcgtggggagcaaacaggattagataccctggtagtccacgccgtaaacgatgagtgctagttgtcgggacttcggtttcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaacccttgacatccctatcgcgattaccagagatggttttcatcagttcggctggataggtgacaggtgctgcatggctgtcgtcagctcgtgtcgtgagatgttgggttaagtcccgcaacgagcgcaacccctatccttagttgccagcatttagttgggcactctagggagactgccggtgacaagccggaggaaggcggggatgacgtcaagtcctcatggcccttacgggttgggctacacacgtgctacaatggtaactacagagggctgcttcttggcaacaagtggcgaatcccaaaaagttatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaagacggtgggctaaccagatttatctggaggcagccggccacggtaaggtcagcgactggggtgaagtcgtaacaaggtagccgtaggggaacctgcggctggatcacctcctttcaagga

SEQ ID NO: 9666 - DNA, 1508 bp, Thalassospira australica
  ref <308>: DATABASE ACCESSION NUMBER: NCBI ACCESSION: NZ_JRJE01000018.1
  ref <309>: DATABASE ENTRY DATE: 2019-04-01
  ref <313>: RELEVANT RESIDUES IN SEQ ID NO: (1)..(1508)
ttggattgaacatgagagtttgatcctggctcagaacgaacgctggcggcaggcctaacacatgcaagtcggacgagaaggttccttcgggaactggagagtggcgcacgggtgagtaacgcgtggggacctacctcttagtgggggataacggttggaaacgaccgctaataccgcatacgcccttcgggggaaagatttatcgctaagagatggacccgcgttggattagatagttggtgaggtaatggctcaccaagtcggcgatccatagctggtttgagaggatgatcagccacactgggactgagacacggcccagactcctacgggaggcagcagtggggaatattggacaatgggggcaaccctgatccagccatgccgcgtgagtgaagaaggccttcgggttgtaaagctctttcagatgcgaagatgatgacggtaacatcagaagaagccccggctaatttcgtgccagcagccgcggtaatacgaaaggggctagcgttgttcggatttactgggcgtaaagggcacgcaggcggtcttgccagtcaggggtgaaagcccggggctcaaccccggaactgcctctgatactgcaagactagagactaggagagggtggtggaattcccagtgtagaggtgaaattcgtagatattgggaggaacaccagaggcgaaggcggccacctggactagatctgacgctcaggtgcgaaagcgtggggagcaaacaggattagataccctggtagtccacgccgtaaacgatgagtgctagttgtcgggacttcggtttcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaacccttgacatccctatcgcgattaccagagatggttttcatcagttcggctggataggtgacaggtgctgcatggctgtcgtcagctcgtgtcgtgagatgttgggttaagtcccgcaacgagcgcaacccctgttcctagttgccagcattcagttgggcactctagggagactgccggtgacaagccggaggaaggcggggatgacgtcaagtcctcatggcccttacgggttgggctacacacgtgctacaatggtaactacagagggcagcgacttagcgataagtagccaatcccaaaaagttatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaagacggtgggctaaccttttaggaggcagccggccacggtaaggtcagcgactggggtgaagtcgtaacaaggtagccgtaggggaacctgcggctggatcacctcctttcaagga

SEQ ID NO: 9667 - DNA, 1500 bp, Thalassospira indica
  ref <308>: DATABASE ACCESSION NUMBER: NCBI ACCESSION: NZ_CP031555.1
  ref <309>: DATABASE ENTRY DATE: 2019-04-01
  ref <313>: RELEVANT RESIDUES IN SEQ ID NO: (1)..(1500)
gaacatgagagtttgatcctggctcagaacgaacgctggcggcaggcctaacacatgcaagtcggacgagaaggtagcttcggctactggagagtggcgcacgggtgagtaacgcgtggggacctacctcttagtgggggataacggttggaaacgaccgctaataccgcatacgcccttcgggggaaagatttatcgctaagagatggacccgcgttggattagatagttggtgaggtaacggctcaccaagtcagcgatccatagctggtttgagaggatgatcagccacactgggactgagacacggcccagactcctacgggaggcagcagtggggaatattggacaatgggggcaaccctgatccagccatgccgcgtgagtgaagaaggccttcgggttgtaaagctctttcagatgcgaagatgatgacggtaacatcagaagaagccccggctaatttcgtgccagcagccgcggtaatacgaaaggggctagcgttgttcggatttactgggcgtaaagggcacgcaggcggtcttgccagtcaggggtgaaagcccgaggctcaacctcggaactgcctctgatactgtaagacttgagactaggagagggtggtggaattcccagtgtagaggtgaaattcgtagatattgggaggaacaccagaggcgaaggcggccacctggactagatctgacgctcaggtgcgaaagcgtggggagcaaacaggattagataccctggtagtccacgccgtaaacgatgagtgctagttgtcgggacttcggtttcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaacccttgacatccctatcgcgattaccagagatggttttcatcagttcggctggataggtgacaggtgctgcatggctgtcgtcagctcgtgtcgtgagatgttgggttaagtcccgcaacgagcgcaacccctgttcctagttgccagcattcagttgggcactctagggagactgccggtgacaagccggaggaaggcggggatgacgtcaagtcctcatggcccttacgggttgggctacacacgtgctacaatggtaactacagagggcagcgacttagcgataagtagccaatcccaaaaagttatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaagacggtgggctaaccttttaggaggcagccggccacggtaaggtcagcgactggggtgaagtcgtaacaaggtagccgtaggggaacctgcggctggatcacctcctttcaagg

SEQ ID NO: 9668 - DNA, 1505 bp, Thalassospira lohafexi
  ref <308>: DATABASE ACCESSION NUMBER: NCBI ACCESSION: NZ_NXGX01000021.1
  ref <309>: DATABASE ENTRY DATE: 2019-04-01
  ref <313>: RELEVANT RESIDUES IN SEQ ID NO: (1)..(1505)
gaacatgagagtttgatcctggctcagaacgaacgctggcggcaggcctaacacatgcaagtcgtacgagaaggttctttcgggaactggagagtggcgcacgggtgagtaacgcgtggggacctacctcttagtgggggataacggttggaaacgaccgctaataccgcatacgcccttcgggggaaagatttatcgctaagagatggacccgcgttggattagatagttggtgaggtaatggctcaccaagtcggcgatccatagctggtttgagaggatgatcagccacactgggactgagacacggcccagactcctacgggaggcagcagtggggaatattggacaatgggggcaaccctgatccagccatgccgcgtgagtgaagaaggccttcgggttgtaaagctctttcagatgcgaagatgatgacggtaacatcagaagaagccccggctaatttcgtgccagcagccgcggtaatacgaaaggggcaagcgttgttcggatttactgggcgtaaagggcacgcaggcggtcttgccagtcaggggtgaaagcccggggctcaaccccggaactgcctctgatactgcaagactagagactaggagagggtggtggaattcccagtgtagaggtgaaattcgtagatattgggaggaacaccagaggcgaaggcggccacctggactagatctgacgctcaggtgcgaaagcgtggggagcaaacaggattagataccctggtagtccacgccgtaaacgatgagtgctagttgtcgggacttcggtttcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaacccttgacatccctatcgcgatttccagagatggatttcatcagttcggctggataggtgacaggtgctgcatggctgtcgtcagctcgtgtcgtgagatgttgggttaagtcccgcaacgagcgcaacccctatccttagttgccagcatttagttgggcactctagggagactgccggtgacaagccggaggaaggcggggatgacgtcaagtcctcatggcccttacgggttgggctacacacgtgctacaatggtaactacagagggctgcttcttggcaacaagtggcgaatcccaaaaagttatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaagacggtgggctaaccagatttatctggaggcagccggccacggtaaggtcagcgactggggtgaagtcgtaacaaggtagccgtaggggaacctgcggctggatcacctcctttcaagg

SEQ ID NO: 9669 - DNA, 1500 bp, Thalassospira marina
  ref <308>: DATABASE ACCESSION NUMBER: NCBI ACCESSION: NZ_CP024199.1
  ref <309>: DATABASE ENTRY DATE: 2019-04-01
  ref <313>: RELEVANT RESIDUES IN SEQ ID NO: (1)..(1500)
gaacatgagagtttgatcctggctcagaacgaacgctggcggcaggcctaacacatgcaagtcgtacgagaaggttccttcgggaactggagagtggcgcacgggtgagtaacgcgtggggacctaccttttagtgggggataacggttggaaacgaccgctaataccgcatacgcccttcgggggaaagatttatcgctaaaagatggacccgcgttggattagatagttggtgaggtaacggctcaccaagtcagcgatccatagctggtttgagaggatgatcagccacactgggactgagacacggcccagactcctacgggaggcagcagtggggaatattggacaatgggcgcaagcctgatccagccatgccgcgtgagtgaagaaggccttcgggttgtaaagctctttcagatgcgaagatgatgacggtaacatcagaagaagccccggctaatttcgtgccagcagccgcggtaatacgaaaggggcaagcgttgttcggatttactgggcgtaaagggcacgcaggcggtctcgccagtcaggggtgaaagcccggggctcaaccccggaactgcctctgatactgtgagactagagactaggagagggtggtggaattcccagtgtagaggtgaaattcgtagatattgggaggaacaccagaggcgaaggcggccacctggactagatctgacgctcaggtgcgaaagcgtggggagcaaacaggattagataccctggtagtccacgccgtaaacgatgagtgctagttgtcgggatttcgatttcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaacccttgacatcctgatcgcgattaccagagatggttttcttcagttcggctggatcagtgacaggtgctgcatggctgtcgtcagctcgtgtcgtgagatgttgggttaagtcccgcaacgagcgcaacccctattcccagttgccagcattgagttgggcactctggggagactgccggtgacaagccggaggaaggcggggatgacgtcaagtcctcatggcccttacgggttgggctacacacgtgctacaatggtaactacagagggtagcggcctggtgacaggtagccaatcccaaaaagttatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaagacggtgggctaaccttttaggaggcagccggccacggtaaggtcagcgactggggtgaagtcgtaacaaggtagccgtaggggaacctgcggctggatcacctcctttcaagg

SEQ ID NO: 9670 - DNA, 855 bp, Thalassospira mesophila
  ref <308>: DATABASE ACCESSION NUMBER: NCBI ACCESSION: NZ_JFKA01000036.1
  ref <309>: DATABASE ENTRY DATE: 2019-04-01
  ref <313>: RELEVANT RESIDUES IN SEQ ID NO: (1)..(855)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgttcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttacctaatacgtgattgttttgacgttaccgacagaataagcaccggctaactctgtgccagcagccgcggtaatacagagggtgcaagcgttaatcggaattactgggcgtaaagcgcgcgtaggtggttagttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcag

SEQ ID NO: 9671 - DNA, 1507 bp, Thalassospira permensis
  ref <308>: DATABASE ACCESSION NUMBER: NCBI ACCESSION: NZ_AUNC01000051.1
  ref <309>: DATABASE ENTRY DATE: 2019-04-01
  ref <313>: RELEVANT RESIDUES IN SEQ ID NO: (1)..(1507)
ttggattgaacatgagagtttgatcctggctcagaacgaacgctggcggcaggcctaacacatgcaagtcgtacgagaaggttctttcgggaactggagagtggcgcacgggtgagtaacgcgtggggacctacctcttagtgggggataacggttggaaacgaccgctaataccgcatacgcccttcgggggaaagatttatcgctaagagatggacccgcgttggattagatagttggtgaggtaacggctcaccaagtcagcgatccatagctggtttgagaggatgatcagccacactgggactgagacacggcccagactcctacgggaggcagcagtggggaatattggacaatgggcgcaagcctgatccagccatgccgcgtgagtgaagaaggccttcgggttgtaaagctctttcagatgcgaagatgatgacggtaacatcagaagaagccccggctaatttcgtgccagcagccgcggtaatacgaaaggggcaagcgttgttcggatttactgggcgtaaagggcacgcaggcggtcttgccagtcaggggtgaaagcccggggctcaaccccggaactgcctctgatactgcaggactagagactaggagagggtggtggaattcccagtgtagaggtgaaattcgtagatattgggaggaacaccagaggcgaaggcggccacctggactagatctgacgctcaggtgcgaaagcgtggggagcaaacaggattagataccctggtagtccacgccgtaaacgatgagtgctagttgtcgggatttcgatttcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaacccttgacatccctatcgcgatttccagagatggatatcatcagttcggctggataggtgacaggtgctgcatggctgtcgtcagctcgtgtcgtgagatgttgggttaagtcccgcaacgagcgcaacccctgttcctagttgccagcattcagttgggcactctagggagactgccggtgacaagccggaggaaggcggggatgacgtcaagtcctcatggcccttacgggttgggctacacacgtgctacaatggtaactacagagggcagcgacttagcgataagtagccaatcccaaaaagttatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaagacggtgggctaaccttttaggaggcagccggccacggtaaggtcagcgactggggtgaagtcgtaacaaggtagccgtaggggaacctgcggctggatcacctcctttcaagg

SEQ ID NO: 9672 - DNA, 1422 bp, Thalassospira sp. 11-3
  ref <308>: DATABASE ACCESSION NUMBER: NCBI ACCESSION: NZ_QJKA01000019.1
  ref <309>: DATABASE ENTRY DATE: 2019-04-01
  ref <313>: RELEVANT RESIDUES IN SEQ ID NO: (1)..(1422)
ttcgggaactggagagtggcgcacgggtgagtaacgcgtggggacctacctcttagtgggggataacggttggaaacgaccgctaataccgcatacgcccttcgggggaaagatttatcgctaagagatggacccgcgttggattagatagttggtgaggtaacggctcaccaagtcagcgatccatagctggtttgagaggatgatcagccacactgggactgagacacggcccagactcctacgggaggcagcagtggggaatattggacaatgggcggaagcctgatccagccatgccgcgtgagtgaagaaggccttcgggttgtaaagctctttcagatgcgaagatgatgacggtaacatcagaagaagccccggctaatttcgtgccagcagccgcggtaatacgaaaggggcaagcgttgttcggatttactgggcgtaaagggcacgcaggcggtcttgccagtcaggggtgaaagcccggggctcaaccccggaactgcctctgatactgcaggactagagactaggagagggtggtggaattcccagtgtagaggtgaaattcgtagatattgggaggaacaccagaggcgaaggcggccacctggactagatctgacgctcaggtgcgaaagcgtggggagcaaacaggattagataccctggtagtccacgccgtaaacgatgagtgctagttgtcgggatttcgatttcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaacccttgacatccctatcgcgatttccagagatggatatcatcagttcggctggataggtgacaggtgctgcatggctgtcgtcagctcgtgtcgtgagatgttgggttaagtcccgcaacgagcgcaacccctgttcctagttgccagcattcagttgggcactctagggagactgccggtgacaagccggaggaaggcggggatgacgtcaagtcctcatggcccttacgggttgggctacacacgtgctacaatggtaactacagagggcagcgacttagcgataagtagccaatcccaaaaagttatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaagacggtgggctaaccttttaggaggcagccggccacggtaaggtcagcgactggggtgaagtcgtaacaaggtagccgtaggggaacctgcggctggatcacctcctttcaagg

SEQ ID NO: 9673 - DNA, 1500 bp, Thalassospira sp. DSM 26710
  ref <308>: DATABASE ACCESSION NUMBER: NCBI ACCESSION: NZ_RAPP01000009.1
  ref <309>: DATABASE ENTRY DATE: 2019-04-01
  ref <313>: RELEVANT RESIDUES IN SEQ ID NO: (1)..(1500)
gaacatgagagtttgatcctggctcagaacgaacgctggcggcaggcctaacacatgcaagtcggacgagaaggtaccttcgggtactggagagtggcgcacgggtgagtaacgcgtggggacctacctcttagtgggggataacggttggaaacgaccgctaataccgcatacgcccttcgggggaaagatttatcgctaagagatggacccgcgttggattagatagttggtgaggtaacggctcaccaagtcagcgatccatagctggtttgagaggatgatcagccacactgggactgagacacggcccagactcctacgggaggcagcagtggggaatattggacaatgggggcaaccctgatccagccatgccgcgtgagtgaagaaggccttcgggttgtaaagctctttcagatgcgaagatgatgacggtaacatcagaagaagccccggctaatttcgtgccagcagccgcggtaatacgaaaggggctagcgttgttcggatttactgggcgtaaagggcacgcaggcggtcttgccagtcaggggtgaaagcccgaggctcaacctcggaactgcctctgatactgtaagacttgagactaggagagggtggtggaattcccagtgtagaggtgaaattcgtagatattgggaggaacaccagaggcgaaggcggccacctggactagatctgacgctcaggtgcgaaagcgtggggagcaaacaggattagataccctggtagtccacgccgtaaacgatgagtgctagttgtcgggatttcgatttcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaacccttgacatccctatcgcgattaccagagatggttttcatcagttcggctggataggtgacaggtgctgcatggctgtcgtcagctcgtgtcgtgagatgttgggttaagtcccgcaacgagcgcaacccctgttcctagttgccagcatttagttgggcactctagggagactgccggtgacaagccggaggaaggcggggatgacgtcaagtcctcatggcccttacgggttgggctacacacgtgctacaatggtaactacagagggcagcgacttagcgataagtagccaatcccaaaaagttatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaagacggtgggctaaccttttaggaggcagccggccacggtaaggtcagcgactggggtgaagtcgtaacaaggtagccgtaggggaacctgcggctggatcacctcctttcaagg

SEQ ID NO: 9674 - DNA, 1505 bp, Thalassospira sp. GB04J01
  ref <308>: DATABASE ACCESSION NUMBER: NCBI ACCESSION: NZ_CCDX020000029.1
  ref <309>: DATABASE ENTRY DATE: 2019-04-01
  ref <313>: RELEVANT RESIDUES IN SEQ ID NO: (1)..(1505)
gaacatgagagtttgatcctggctcagaacgaacgctggcggcaggcctaacacatgcaagtcgtacgagaaggttccttcgggaactggagagtggcgcacgggtgagtaacgcgtggggacctacctcttagtgggggataacggttggaaacgaccgctaataccgcatacgcccttcgggggaaagatttatcgctaagagatggacccgcgttggattagatagttggtgaggtaatggctcaccaagtcggcgatccatagctggtttgagaggatgatcagccacactgggactgagacacggcccagactcctacgggaggcagcagtggggaatattggacaatgggggcaaccctgatccagccatgccgcgtgagtgaagaaggccttcgggttgtaaagctctttcagatgcgaagatgatgacggtaacatcagaagaagccccggctaatttcgtgccagcagccgcggtaatacgaaaggggcaagcgttgttcggatttactgggcgtaaagggcacgcaggcggtcttgccagtcaggggtgaaagcccggggctcaaccccggaactgcctctgatactgcaagactagagactaggagagggtggtggaattcccagtgtagaggtgaaattcgtagatattgggaggaacaccagaggcgaaggcggccacctggactagatctgacgctcaggtgcgaaagcgtggggagcaaacaggattagataccctggtagtccacgccgtaaacgatgagtgctagttgtcgggacttcggtttcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaacccttgacatccctatcgcgatttccagagatggatttcatcagttcggctggataggtgacaggtgctgcatggctgtcgtcagctcgtgtcgtgagatgttgggttaagtcccgcaacgagcgcaacccctatccttagttgccagcatttagttgggcactctagggagactgccggtgacaagccggaggaaggcggggatgacgtcaagtcctcatggcccttacgggttgggctacacacgtgctacaatggtaactacagagggctgcttcttggcaacaagtggcgaatcccaaaaagttatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaagacggtgggctaaccagatttatctggaggcagccggccacggtaaggtcagcgactggggtgaagtcgtaacaaggtagccgtaggggaacctgcggctggatcacctcctttcaagg

SEQ ID NO: 9675 - DNA, 1508 bp, Thalassospira sp. HJ
  ref <308>: DATABASE ACCESSION NUMBER: NCBI ACCESSION: NZ_JYII01000016.1
  ref <309>: DATABASE ENTRY DATE: 2019-04-01
  ref <313>: RELEVANT RESIDUES IN SEQ ID NO: (1)..(1508)
ttggattgaacatgagagtttgatcctggctcagaacgaacgctggcggcaggcctaacacatgcaagtcggacgagaaggtaccttcgggtactggagagtggcgcacgggtgagtaacgcgtggggacctacctcttagtgggggataacggttggaaacgaccgctaataccgcatacgcccttcgggggaaagatttatcgctaagagatggacccgcgttggattagatagttggtgaggtaacggctcaccaagtcagcgatccatagctggtttgagaggatgatcagccacactgggactgagacacggcccagactcctacgggaggcagcagtggggaatattggacaatgggggcaaccctgatccagccatgccgcgtgagtgaagaaggccttcgggttgtaaagctctttcagatgcgaagatgatgacggtaacatcagaagaagccccggctaatttcgtgccagcagccgcggtaatacgaaaggggctagcgttgttcggatttactgggcgtaaagggcacgcaggcggtcttgccagtcaggggtgaaagcccgaggctcaacctcggaactgcctctgatactgtaagacttgagactaggagagggtggtggaattcccagtgtagaggtgaaattcgtagatattgggaggaacaccagaggcgaaggcggccacctggactagatctgacgctcaggtgcgaaagcgtggggagcaaacaggattagataccctggtagtccacgccgtaaacgatgagtgctagttgtcgggatttcgatttcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaacccttgacatccctatcgcgattaccagagatggttttcatcagttcggctggataggtgacaggtgctgcatggctgtcgtcagctcgtgtcgtgagatgttgggttaagtcccgcaacgagcgcaacccctgttcctagttgccagcatttagttgggcactctagggagactgccggtgacaagccggaggaaggcggggatgacgtcaagtcctcatggcccttacgggttgggctacacacgtgctacaatggtaactacagagggcagcgacttagcgataagtagccaatcccaaaaagttatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaagacggtgggctaaccttttaggaggcagccggccacggtaaggtcagcgactggggtgaagtcgtaacaaggtagccgtaggggaacctgcggctggatcacctcctttcaagga

SEQ ID NO: 9676 - DNA, 1507 bp, Thalassospira sp. KO164
  ref <308>: DATABASE ACCESSION NUMBER: NCBI ACCESSION: NZ_FNTU01000002.1
  ref <309>: DATABASE ENTRY DATE: 2019-04-01
  ref <313>: RELEVANT RESIDUES IN SEQ ID NO: (1)..(1507)
ttggattgaacatgagagtttgatcctggctcagaacgaacgctggcggcaggcctaacacatgcaagtcgtacgagaaggttccttcgggaactggagagtggcgcacgggtgagtaacgcgtggggacctacctcttagtgggggataacggttggaaacgaccgctaataccgcatacgcccttcgggggaaagatttatcgctaagagatggacccgcgttggattagatagttggtgaggtaacggctcaccaagtcagcgatccatagctggtttgagaggatgatcagccacactgggactgagacacggcccagactcctacgggaggcagcagtggggaatattggacaatgggcggaagcctgatccagccatgccgcgtgagtgaagaaggccttcgggttgtaaagctctttcagatgcgaagatgatgacggtaacatcagaagaagccccggctaatttcgtgccagcagccgcggtaatacgaaaggggcaagcgttgttcggatttactgggcgtaaagggcacgcaggcggtcttgccagtcaggggtgaaagcccggggctcaaccccggaactgcctctgatactgcaggactagagactaggagagggtggtggaattcccagtgtagaggtgaaattcgtagatattgggaggaacaccagaggcgaaggcggccacctggactagatctgacgctcaggtgcgaaagcgtggggagcaaacaggattagataccctggtagtccacgccgtaaacgatgagtgctagttgtcgggatttcgatttcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaacccttgacatccctatcgcgatttccagagatggatatcatcagttcggctggataggtgacaggtgctgcatggctgtcgtcagctcgtgtcgtgagatgttgggttaagtcccgcaacgagcgcaacccctgttcctagttgccagcattcagttgggcactctagggagactgccggtgacaagccggaggaaggcggggatgacgtcaagtcctcatggcccttacgggttgggctacacacgtgctacaatggtaactacagagggcagcgacttagcgataagtagccaatcccaaaaagttatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaagacggtgggctaaccttttaggaggcagccggccacggtaaggtcagcgactggggtgaagtcgtaacaaggtagccgtaggggaacctgcggctggatcacctcctttcaagg

SEQ ID NO: 9677 - DNA, 1508 bp, Thalassospira sp. MCCC 1A01148
  ref <308>: DATABASE ACCESSION NUMBER: NCBI ACCESSION: NZ_LPVZ01000016.1
  ref <309>: DATABASE ENTRY DATE: 2019-04-01
  ref <313>: RELEVANT RESIDUES IN SEQ ID NO: (1)..(1508)
ttggattgaacatgagagtttgatcctggctcagaacgaacgctggcggcaggcctaacacatgcaagtcggacgagaaggtaccttcgggtactggagagtggcgcacgggtgagtaacgcgtggggacctacctcttagtgggggataacggttggaaacgaccgctaataccgcatacgcccttcgggggaaagatttatcgctaagagatggacccgcgttggattagatagttggtgaggtaacggctcaccaagtcagcgatccatagctggtttgagaggatgatcagccacactgggactgagacacggcccagactcctacgggaggcagcagtggggaatattggacaatgggggcaaccctgatccagccatgccgcgtgagtgaagaaggccttcgggttgtaaagctctttcagatgcgaagatgatgacggtaacatcagaagaagccccggctaatttcgtgccagcagccgcggtaatacgaaaggggctagcgttgttcggatttactgggcgtaaagggcacgcaggcggtcttgccagtcaggggtgaaagcccgaggctcaacctcggaactgcctctgatactgtaagacttgagactaggagagggtggtggaattcccagtgtagaggtgaaattcgtagatattgggaggaacaccagaggcgaaggcggccacctggactagatctgacgctcaggtgcgaaagcgtggggagcaaacaggattagataccctggtagtccacgccgtaaacgatgagtgctagttgtcgggacttcggtttcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaacccttgacatccctatcgcgattaccagagatggttttcatcagttcggctggataggtgacaggtgctgcatggctgtcgtcagctcgtgtcgtgagatgttgggttaagtcccgcaacgagcgcaacccctgttcctagttgccagcattcagttgggcactctagggagactgccggtgacaagccggaggaaggcggggatgacgtcaagtcctcatggcccttacgggttgggctacacacgtgctacaatggtaactacagagggcagcgacttagcgataagtagccaatcccaaaaagttatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaagacggtgggctaaccttttaggaggcagccggccacggtaaggtcagcgactggggtgaagtcgtaacaaggtagccgtaggggaacctgcggctggatcacctcctttcaagga

SEQ ID NO: 9678 - DNA, 1498 bp, Thalassospira sp. MCCC 1A01428
  ref <308>: DATABASE ACCESSION NUMBER: NCBI ACCESSION: NZ_JFJZ01000125.1
  ref <309>: DATABASE ENTRY DATE: 2019-04-01
  ref <313>: RELEVANT RESIDUES IN SEQ ID NO: (1)..(1498)
gagtttgatcctggctcagaacgaacgctggcggcaggcctaacacatgcaagtcggacgagaaggttccttcgggaactggagagtggcgcacgggtgagtaacgcgtggggacctaccttttagtgggggataacggttggaaacgaccgctaataccgcatacgcccttttggggaaagatttatcgctaaaagatggacccgcgttggattagatagttggtgaggtaacggctcaccaagtcttcgatccatagctggtttgagaggatgatcagccacactgggactgagacacggcccagactcctacgggaggcagcagtggggaatattggacaatgggcggaagcctgatccagccatgccgcgtgagtgaagaaggccttcgggttgtaaagctctttcagatgcgaagatgatgacggtaacatcagaagaagccccggctaatttcgtgccagcagccgcggtaatacgaaaggggcaagcgttgttcggatttactgggcgtaaagggcacgcaggcggtcttgccagtcaggggtgaaagcccggggctcaaccccggaactgcctctgatactgcaggactagagactaggagagggtggtggaattcccagtgtagaggtgaaattcgtagatattgggaggaacaccagaggcgaaggcggccacctggactagatctgacgctcaggtgcgaaagcgtggggagcaaacaggattagataccctggtagtccacgccgtaaacgatgagtgctagttgtcgggacttcggtttcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaacccttgacatccctatcgcgaataccagagatggttttcatcagttcggctggataggtgacaggtgctgcatggctgtcgtcagctcgtgtcgtgagatgttgggttaagtcccgcaacgagcgcaacccctattctcagttgccagcattcagttgggcactctggggagactgccggtgacaagccggaggaaggcggggatgacgtcaagtcctcatggcccttacgggttgggctacacacgtgctacaatggtaactacagagggctgcttcctggcgacaggtggcgaatcccaaaaagttatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaagacggtgggctaaccagatttatctggaggcagccggccacggtaaggtcagcgactggggtgaagtcgtaacaaggtagccgtaggggaacctgcggctggatcacctcctttcaagga

SEQ ID NO: 9679 - DNA, 1508 bp, Thalassospira sp. MCCC 1A02803
  ref <308>: DATABASE ACCESSION NUMBER: NCBI ACCESSION: NZ_JAMA01000017.1
  ref <309>: DATABASE ENTRY DATE: 2019-04-01
  ref <313>: RELEVANT RESIDUES IN SEQ ID NO: (1)..(1508)
ttggattgaacatgagagtttgatcctggctcagaacgaacgctggcggcaggcctaacacatgcaagtcggacgagaaggttccttcgggaactggagagtggcgcacgggtgagtaacgcgtggggacctacctcttagtgggggataacggttggaaacgaccgctaataccgcatacgcccttcgggggaaagatttatcgctaagagatggacccgcgttggattagatagttggtgaggtaacggctcaccaagtcagcgatccatagctggtttgagaggatgatcagccacactgggactgagacacggcccagactcctacgggaggcagcagtggggaatattggacaatgggggcaaccctgatccagccatgccgcgtgagtgaagaaggccttcgggttgtaaagctctttcagatgcgaagatgatgacggtaacatcagaagaagccccggctaatttcgtgccagcagccgcggtaatacgaaaggggctagcgttgttcggatttactgggcgtaaagggcacgcaggcggtcttgccagtcaggggtgaaagcccgaggctcaacctcggaactgcctctgatactgtaagacttgagactaggagagggtggtggaattcccagtgtagaggtgaaattcgtagatattgggaggaacaccagaggcgaaggcggccacctggactagatctgacgctcaggtgcgaaagcgtggggagcaaacaggattagataccctggtagtccacgccgtaaacgatgagtgctagttgtcgggacttcggtttcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaacccttgacatccctatcgcgattaccagagatggttttcatcagttcggctggataggtgacaggtgctgcatggctgtcgtcagctcgtgtcgtgagatgttgggttaagtcccgcaacgagcgcaacccctgttcctagttgccagcatttagttgggcactctagggagactgccggtgacaagccggaggaaggcggggatgacgtcaagtcctcatggcccttacgggttgggctacacacgtgctacaatggtaactacagagggcagcgacttagcgataagtagccaatcccaaaaagttatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaagacggtgggctaaccttttaggaggcagccggccacggtaaggtcagcgactggggtgaagtcgtaacaaggtagccgtaggggaacctgcggctggatcacctcctttcaagga

SEQ ID NO: 9680 - DNA, 1508 bp, Thalassospira sp. MCCC 1A03138
  ref <308>: DATABASE ACCESSION NUMBER: NCBI ACCESSION: NZ_JFJY01000019.1
  ref <309>: DATABASE ENTRY DATE: 2019-04-01
  ref <313>: RELEVANT RESIDUES IN SEQ ID NO: (1)..(1508)
ttggattgaacatgagagtttgatcctggctcagaacgaacgctggcggcaggcctaacacatgcaagtcgtacgagaaggttccttcgggaactggagagtggcgcacgggtgagtaacgcgtggggacctacctcttagtgggggataacggttggaaacgaccgctaataccgcatacgcccttcgggggaaagatttatcgctaagagatggacccgcgttggattagatagttggtgaggtaacggctcaccaagtcagcgatccatagctggtttgagaggatgatcagccacactgggactgagacacggcccagactcctacgggaggcagcagtggggaatattggacaatgggcgcaagcctgatccagccatgccgcgtgagtgaagaaggccttcgggttgtaaagctctttcagatgcgaagatgatgacggtaacatcagaagaagccccggctaatttcgtgccagcagccgcggtaatacgaaaggggcaagcgttgttcggatttactgggcgtaaagggcacgcaggcggtcttgccagtcaggggtgaaagcccggggctcaaccccggaactgcctctgatactgcaggactagagactaggagagggtggtggaattcccagtgtagaggtgaaattcgtagatattgggaggaacaccagaggcgaaggcggccacctggactagatctgacgctcaggtgcgaaagcgtggggagcaaacaggattagataccctggtagtccacgccgtaaacgatgagtgctagttgtcgggatttcgatttcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaacccttgacatccctatcgcgatttccagagatggatatcatcagttcggctggataggtgacaggtgctgcatggctgtcgtcagctcgtgtcgtgagatgttgggttaagtcccgcaacgagcgcaacccctgttcctagttgccagcattcagttgggcactctagggagactgccggtgacaagccggaggaaggcggggatgacgtcaagtcctcatggcccttacgggttgggctacacacgtgctacaatggtaactacagagggcagcgacttagcgataagtagccaatcccaaaaagttatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaagacggtgggctaaccttttaggaggcagccggccacggtaaggtcagcgactggggtgaagtcgtaacaaggtagccgtaggggaacctgcggctggatcacctcctttcaagga

SEQ ID NO: 9681 - DNA, 1507 bp, Thalassospira sp. MIT1004
  ref <308>: DATABASE ACCESSION NUMBER: NCBI ACCESSION: NZ_MCAO01000024.1
  ref <309>: DATABASE ENTRY DATE: 2019-04-01
  ref <313>: RELEVANT RESIDUES IN SEQ ID NO: (1)..(1507)
ttggattgaacatgagagtttgatcctggctcagaacgaacgctggcggcaggcctaacacatgcaagtcgtacgagaaggttccttcgggaactggagagtggcgcacgggtgagtaacgcgtggggacctacctcttagtgggggataacggttggaaacgaccgctaataccgcatacgcccttcgggggaaagatttatcgctaagagatggacccgcgttggattagatagttggtgaggtaacggctcaccaagtcagcgatccatagctggtttgagaggatgatcagccacactgggactgagacacggcccagactcctacgggaggcagcagtggggaatattggacaatgggcgcaagcctgatccagccatgccgcgtgagtgaagaaggccttcgggttgtaaagctctttcagatgcgaagatgatgacggtaacatcagaagaagccccggctaatttcgtgccagcagccgcggtaatacgaaaggggcaagcgttgttcggatttactgggcgtaaagggcacgcaggcggtcttgccagtcaggggtgaaagcccggggctcaaccccggaactgcctctgatactgcaggactagagactaggagagggtggtggaattcccagtgtagaggtgaaattcgtagatattgggaggaacaccagaggcgaaggcggccacctggactagatctgacgctcaggtgcgaaagcgtggggagcaaacaggattagataccctggtagtccacgccgtaaacgatgagtgctagttgtcgggatttcgatttcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaacccttgacatccctatcgcgatttccagagatggatatcatcagttcggctggataggtgacaggtgctgcatggctgtcgtcagctcgtgtcgtgagatgttgggttaagtcccgcaacgagcgcaacccctgttcctagttgccagcattcagttgggcactctagggagactgccggtgacaagccggaggaaggcggggatgacgtcaagtcctcatggcccttacgggttgggctacacacgtgctacaatggtaactacagagggcagcgacttagcgataagtagccaatcccaaaaagttatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaagacggtgggctaaccttttaggaggcagccggccacggtaaggtcagcgactggggtgaagtcgtaacaaggtagccgtaggggaacctgcggctggatcacctcctttcaagg

SEQ ID NO: 9682 - DNA, 1508 bp, Thalassospira sp. TSL5-1
  ref <308>: DATABASE ACCESSION NUMBER: NCBI ACCESSION: NZ_KV880647.1
  ref <309>: DATABASE ENTRY DATE: 2019-04-01
  ref <313>: RELEVANT RESIDUES IN SEQ ID NO: (1)..(1508)
ttggattgaacatgagagtttgatcctggctcagaacgaacgctggcggcaggcctaacacatgcaagtcgtacgagaaggttctttcgggaactggagagtggcgcacgggtgagtaacgcgtggggacctacctttcagtgggggataacggttggaaacgaccgctaataccgcatacgcccttcgggggaaagatttatcgctgaaagatggacccgcgttggattagatagttggtgaggtaacggctcaccaagtcagcgatccatagctggtttgagaggatgatcagccacactgggactgagacacggcccagactcctacgggaggcagcagtgggggatattggacaatgggcggaagcctgatccagccatgccgcgtgagtgaagaaggccttcgggttgtaaagctctttcagatgcgaagatgatgacggtaacatcagaagaagccccggctaatttcgtgccagcagccgcggtaatacgaaaggggcaagcgttgttcggatttactgggcgtaaagggcacgcaggcggtcttgccagtcaggggtgaaagcccggggctcaaccccggaactgcctctgatactgcaagactagagactaggagagggtggtggaattcccagtgtagaggtgaaattcgtagatattgggaggaacaccagaggcgaaggcggccacctggactagatctgacgctcaggtgcgaaagcgtggggagcaaacaggattagataccctggtagtccacgccgtaaacgatgagtgctagttgtcgggacttcggtttcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaacccttgacatccctatcgcgaataccagagatggttttcatcagttcggctggataggtgacaggtgctgcatggctgtcgtcagctcgtgtcgtgagatgttgggttaagtcccgcaacgagcgcaacccctattcccagttgccagcattgagttgggcactctggggagactgccggtgacaagccggaggaaggcggggatgacgtcaagtcctcatggcccttacgggttgggctacacacgtgctacaatggtaactacagagggcagcggcctggtgacaggtagccaatcccaaaaagttatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaagacggtgggctaaccttttaggaggcagccggccacggtaaggtcagcgactggggtgaagtcgtaacaaggtagccgtaggggaacctgcggctggatcacctcctttcaagga

SEQ ID NO: 9683 - DNA, 1463 bp, Thalassospira tepidiphila
  ref <308>: DATABASE ACCESSION NUMBER: NCBI ACCESSION: NZ_JPVZ01000022.1
  ref <309>: DATABASE ENTRY DATE: 2019-04-01
  ref <313>: RELEVANT RESIDUES IN SEQ ID NO: (1)..(1463)
cgctggcggcaggcctaacacatgcaagtcggacgagaaggtaccttcgggtactggagagtggcgcacgggtgagtaacgcgtggggacctacctcttagtgggggataacggttggaaacgaccgctaataccgcatacgcccttcgggggaaagatttatcgctaagagatggacccgcgttggattagatagttggtgaggtaacggctcaccaagtcagcgatccatagctggtttgagaggatgatcagccacactgggactgagacacggcccagactcctacgggaggcagcagtggggaatattggacaatgggggcaaccctgatccagccatgccgcgtgagtgaagaaggccttcgggttgtaaagctctttcagatgcgaagatgatgacggtaacatcagaagaagccccggctaatttcgtgccagcagccgcggtaatacgaaaggggctagcgttgttcggatttactgggcgtaaagggcacgcaggcggtcttgccagtcaggggtgaaagcccgaggctcaacctcggaactgcctctgatactgtaagacttgagactaggagagggtggtggaattcccagtgtagaggtgaaattcgtagatattgggaggaacaccagaggcgaaggcggccacctggactagatctgacgctcaggtgcgaaagcgtggggagcaaacaggattagataccctggtagtccacgccgtaaacgatgagtgctagttgtcgggacttcggtttcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaacccttgacatccctatcgcgattaccagagatggttttcatcagttcggctggataggtgacaggtgctgcatggctgtcgtcagctcgtgtcgtgagatgttgggttaagtcccgcaacgagcgcaacccctgttcctagttgccagcatttagttgggcactctagggagactgccggtgacaagccggaggaaggcggggatgacgtcaagtcctcatggcccttacgggttgggctacacacgtgctacaatggtaactacagagggcagcgacttagcgataagtagccaatcccaaaaagttatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaagacggtgggctaaccttttaggaggcagccggccacggtaaggtcagcgactggggtgaagtcgtaacaaggtagccgtaggggaacctgcggctggatcacctccttaa

SEQ ID NO: 9684 - DNA, 1500 bp, Thalassospira xiamenensis
  ref <308>: DATABASE ACCESSION NUMBER: NCBI ACCESSION: NZ_OBMM01000019.1
  ref <309>: DATABASE ENTRY DATE: 2019-04-01
  ref <313>: RELEVANT RESIDUES IN SEQ ID NO: (1)..(1500)
gaacatgagagtttgatcctggctcagaacgaacgctggcggcaggcctaacacatgcaagtcgtacgagaaggttccttcgggaactggagagtggcgcacgggtgagtaacgcgtggggacctacctcttagtgggggataacggttggaaacgaccgctaataccgcatacgcccttcgggggaaagatttatcgctaagagatggacccgcgttggattagatagttggtgaggtaacggctcaccaagtcagcgatccatagctggtttgagaggatgatcagccacactgggactgagacacggcccagactcctacgggaggcagcagtggggaatattggacaatgggcgcaagcctgatccagccatgccgcgtgagtgaagaaggccttcgggttgtaaagctctttcagatgcgaagatgatgacggtaacatcagaagaagccccggctaatttcgtgccagcagccgcggtaatacgaaaggggcaagcgttgttcggatttactgggcgtaaagggcacgcaggcggtcctgccagtcaggggtgaaagcccggggctcaaccccggaactgcctctgatactgcaggactagagactaggagagggtggtggaattcccagtgtagaggtgaaattcgtagatattgggaggaacaccagaggcgaaggcggccacctggactagatctgacgctcaggtgcgaaagcgtggggagcaaacaggattagataccctggtagtccacgccgtaaacgatgagtgctagttgtcgggatttcgatttcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaacccttgacatccctatcgcgatttccagagatggatatcatcagttcggctggataggtgacaggtgctgcatggctgtcgtcagctcgtgtcgtgagatgttgggttaagtcccgcaacgagcgcaacccctgttcctagttgccagcattcagttgggcactctagggagactgccggtgacaagccggaggaaggcggggatgacgtcaagtcctcatggcccttacgggttgggctacacacgtgctacaatggtaactacagagggcagcgacttagcgataagtagccaatcccaaaaagttatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaagacggtgggctaaccttttaggaggcagccggccacggtaaggtcagcgactggggtgaagtcgtaacaaggtagccgtaggggaacctgcggctggatcacctcctttcaagg

SEQ ID NO: 9685 - DNA, 1544 bp, Thauera aminoaromatica
  ref <308>: DATABASE ACCESSION NUMBER: NCBI ACCESSION: NZ_AMXD01000247.1
  ref <309>: DATABASE ENTRY DATE: 2019-04-01
  ref <313>: RELEVANT RESIDUES IN SEQ ID NO: (1)..(1544)
gattgaacttaagagtttgatcctggctcagattgaacgctggcggcatgctttacacatgcaagtcgaacggcagcgggggcttcggcctgccggcgagtggcgaacgggtgagtaatgcatcggaacgtgcccatgtcgtgggggataacgtagcgaaagctacgctaataccgcatacgccctgagggggaaagcgggggattcttcggaacctcgcgcgattggagcggccgatgtcggattagctagtaggtgaggtaaaggctcacctaggcgacgatccgtagcgggtctgagaggatgatccgccacactgggactgagacacggcccagactcctacgggaggcagcagtggggaattttggacaatgggcgcaagcctgatccagccatgccgcgtgagtgaagaaggccttcgggttgtaaagctctttcggccgggaagaaatcgtggtctctaacataggccatggatgacggtaccggactaagaagcaccggctaactacgtgccagcagccgcggtaatacgtagggtgcgagcgttaatcggaattactgggcgtaaagcgtgcgcaggcggttttgtaagacagatgtgaaatccccgggcttaacctgggaactgcgtttgtgactgcaaggctagagtacggcagaggggggtggaattcctggtgtagcagtgaaatgcgtagagatcaggaggaacaccgatggcgaaggcagccccctgggcctgtactgacgctcatgcacgaaagcgtggggagcaaacaggattagataccctggtagtccacgccctaaacgatgtcgactagtcgttcggagcagcaatgcactgagtgacgcagctaacgcgtgaagtcgaccgcctggggagtacggccgcaaggttaaaactcaaaggaattgacggggacccgcacaagcggtggatgatgtggattaattcgatgcaacgcgaaaaaccttacctacccttgacatgtctggaaccttgctgagaggcgagggtgccttcgggagccagaacacaggtgctgcatggctgtcgtcagctcgtgtcgtgagatgttgggttaagtcccgcaacgagcgcaacccttgtcactagttgccatcatttggttgggcactctagtgagactgccggtgacaaaccggaggaaggtggggatgacgtcaagtcctcatggcccttatgggtagggcttcacacgtcatacaatggtcggtacagagggttgccaagccgcgaggtggagccaatcccttaaagccgatcgtagtccggatcgtagtctgcaactcgactacgtgaagtcggaatcgctagtaatcgcagatcagcatgctgcggtgaatacgttcccgggtcttgtacacaccgcccgtcacaccatgggagtgggtttcaccagaagtaggtagcttaaccttcgggagggcgcttaccacggtgagattcatgactggggtgaagtcgtaacaaggtagccgtatcggaaggtgcggctggatcacctcctttc

SEQ ID NO: 9686 - DNA, 1545 bp, Thauera aromatica
  ref <308>: DATABASE ACCESSION NUMBER: NCBI ACCESSION: NZ_CP028339.1
  ref <309>: DATABASE ENTRY DATE: 2019-04-01
  ref <313>: RELEVANT RESIDUES IN SEQ ID NO: (1)..(1545)
gattgaacttaagagtttgatcctggctcagattgaacgctggcggcatgctttacacatgcaagtcgaacggcagcgggggcttcggcctgccggcgagtggcgaacgggtgagtaatgcatcggaacgtgcccatgtcgtgggggataacgtatcgaaaggtacgctaataccgcatacgtcctgagggagaaagcgggggatcttcggacctcgcgcgattggagcggccgatgtcggattagctagtaggtgaggtaaaggctcacctaggcgacgatccgtagcgggtctgagaggatgatccgccacactgggactgagacacggcccagactcctacgggaggcagcagtggggaattttggacaatgggggcaaccctgatccagccatgccgcgtgagtgaagaaggccttcgggttgtaaagctctttcggccgggaagaaatcgtggtctctaacataggccatggatgacggtaccggactaagaagcaccggctaactacgtgccagcagccgcggtaatacgtagggtgcgagcgttaatcggaattactgggcgtaaagcgtgcgcaggcggttttgtaagacagatgtgaaatccccgggctcaacctgggaactgcgtttgtgactgcaaggctagagtacggcagaggggggtggaattcctggtgtagcagtgaaatgcgtagagatcaggaggaacaccgatggcgaaggcagccccctgggcctgtactgacgctcatgcacgaaagcgtggggagcaaacaggattagataccctggtagtccacgccctaaacgatgtcgactagtcgttcggagcagcaatgcactgagtgacgcagctaacgcgtgaagtcgaccgcctggggagtacggccgcaaggttaaaactcaaaggaattgacggggacccgcacaagcggtggatgatgtggattaattcgatgcaacgcgaaaaaccttacctacccttgacatgccaggaaccttgctgagaggcgagggtgccttcgggagcctggacacaggtgctgcatggctgtcgtcagctcgtgtcgtgagatgttgggttaagtcccgcaacgagcgcaacccttgtcactagttgccatcatttggttgggcactctagtgagactgccggtgacaaaccggaggaaggtggggatgacgtcaagtcctcatggcccttatgggtagggcttcacacgtcatacaatggtcggtacagagggttgccaagccgcgaggtggagccaatcccaaaaagccgatcgtagtccggatcgtagtctgcaactcgactacgtgaagtcggaatcgctagtaatcgcagatcagcatgctgcggtgaatacgttcccgggtcttgtacacaccgcccgtcacaccatgggagtgggtttcaccagaagtaggtagcttaaccttcgggagggcgcttaccacggtgagattcatgactggggtgaagtcgtaacaaggtagccgtatcggaaggtgcggctggatcacctcctttcaag

SEQ ID NO: 9687 - DNA, 1544 bp, Thauera chlorobenzoica
  ref <308>: DATABASE ACCESSION NUMBER: NCBI ACCESSION: NZ_FNVJ01000051.1
  ref <309>: DATABASE ENTRY DATE: 2019-04-01
  ref <313>: RELEVANT RESIDUES IN SEQ ID NO: (1)..(1544)
gattgaacttaagagtttgatcctggctcagattgaacgctggcggcatgctttacacatgcaagtcgaacggcagcgggggcttcggcctgccggcgagtggcgaacgggtgagtaatgcatcggaacgtgcccatgtcgtgggggataacgtatcgaaaggtacgctaataccgcatacgtcctgagggagaaagcgggggattcttcggaacctcgcgcgattggagcggccgatgtcggattagctagtaggtgaggtaaaggctcacctaggcgacgatccgtagcgggtctgagaggatgatccgccacactgggactgagacacggcccagactcctacgggaggcagcagtggggaattttggacaatgggggcaaccctgatccagccatgccgcgtgagtgaagaaggccttcgggttgtaaagctctttcggccgggaagaaatcgcgcactctaacatagtgtgtggatgacggtaccggactaagaagcaccggctaactacgtgccagcagccgcggtaatacgtagggtgcgagcgttaatcggaattactgggcgtaaagcgtgcgcaggcggttttgtaagacagatgtgaaatccccgggctcaacctgggaactgcgtttgtgactgcaaggctagagtacggcagaggggggtggaattcctggtgtagcagtgaaatgcgtagatatcaggaggaacaccgatggcgaaggcagccccctgggcctgtactgacgctcatgcacgaaagcgtggggagcaaacaggattagataccctggtagtccacgccctaaacgatgtcgactagtcgttcggagcagcaatgcactgagtgacgcagctaacgcgtgaagtcgaccgcctggggagtacggccgcaaggttaaaactcaaaggaattgacggggacccgcacaagcggtggatgatgtggattaattcgatgcaacgcgaaaaaccttacctacccttgacatgtctggaaccttgctgagaggcgagggtgccttcgggagccagaacacaggtgctgcatggctgtcgtcagctcgtgtcgtgagatgttgggttaagtcccgcaacgagcgcaacccttgtcactagttgccatcatttggttgggcactctagtgagactgccggtgacaaaccggaggaaggtggggatgacgtcaagtcctcatggcccttatgggtagggcttcacacgtcatacaatggtcggtacagagggttgccaagccgcgaggtggagccaatcccaaaaagccgatcgtagtccggatcgtagtctgcaactcgactacgtgaagtcggaatcgctagtaatcgcagatcagcatgctgcggtgaatacgttcccgggtcttgtacacaccgcccgtcacaccatgggagtgggtttcaccagaagtaggtagcttaaccttcgggagggcgcttaccacggtgagattcatgactggggtgaagtcgtaacaaggtagccgtatcggaaggtgcggctggatcacctcctttc

SEQ ID NO: 9688 - DNA, 1541 bp, Thauera hydrothermalis
  ref <308>: DATABASE ACCESSION NUMBER: NCBI ACCESSION: NZ_CP029331.1
  ref <309>: DATABASE ENTRY DATE: 2019-04-01
  ref <313>: RELEVANT RESIDUES IN SEQ ID NO: (1)..(1541)
tgaacttaagagtttgatcctggctcagattgaacgctggcggcatgctttacacatgcaagtcgaacggcagcgggggcttcggcctgccggcgagtggcgaacgggtgagtaatgcatcggaacgtacccagtggtgggggatagctcggcgaaagccggattaataccgcatacgccctgagggggaaagtgggggatcttcggacctcacgccattggagcggccgatgtcggattagctagttggtgaggtaaaggctcaccaaggcgacgatccgtagctggtctgagaggatgatcagccacactgggactgagacacggcccagactcctacgggaggcagcagtggggaattttggacaatgggcgcaagcctgatccagccatgccgcgtgagtgaagaaggccttcgggttgtaaagctctttcagtcgggaagaaaaggcgggctctaacatagcctgttgctgacggtaccgacagaagaagcaccggctaactacgtgccagcagccgcggtaatacgtagggtgcgagcgttaatcggaattactgggcgtaaagcgtgcgcaggcggtttgctaagacaggtgtgaaatccccgggcttaacctgggaactgcgcttgtgactggcaggctagagtacggcagaggggggtggaattccacgtgtagcagtgaaatgcgtagagatgtggaggaacaccgatggcgaaggcagccccctgggcctgtactgacgctcatgcacgaaagcgtggggagcaaacaggattagataccctggtagtccacgccctaaacgatgtcaactagtcgttcggagcggtaacgcactgagtgacgcagctaacgcgtgaagttgaccgcctggggagtacggccgcaaggttaaaactcaaaggaattgacggggacccgcacaagcggtggatgatgtggattaattcgatgcaacgcgaaaaaccttacctacccttgacatgccaggaatcttggtgagagccgagagtgccttcgggagcctggacacaggtgctgcatggctgtcgtcagctcgtgtcgtgagatgttgggttaagtcccgcaacgagcgcaacccttgccactaattgccatcattgagttgggcactttagtgggactgccggtgacaaaccggaggaaggtggggatgacgtcaagtcctcatggcccttatgggtagggcttcacacgtcatacaatggtcggtacaaagggttgccaagccgcgaggcggagccaatcccagaaagccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggtttcaccagaagtaggtagcttaaccttcgggagggcgcttaccacggtgagattcatgactggggtgaagtcgtaacaaggtagccgtatcggaaggtgcggctggatcacctcctttcaag

SEQ ID NO: 9689 - DNA, 1507 bp, Thauera phenylacetica
  ref <308>: DATABASE ACCESSION NUMBER: NCBI ACCESSION: NZ_AMXF01000339.1
  ref <309>: DATABASE ENTRY DATE: 2019-04-01
  ref <313>: RELEVANT RESIDUES IN SEQ ID NO: (1)..(1507)
cgctggcggcatgctttacacatgcaagtcgaacggcagcgggggcttcggcctgccggcgagtggcgaacgggtgagtaatgcatcggaacgtgcccatgtcgtgggggataacgtagcgaaagctacgctaataccgcatacgccctgagggggaaagcgggggattcttcggaacctcgcgcgattggagcggccgatgtcggattagctagtaggtgaggtaaaggctcacctaggcgacgatccgtagcgggtctgagaggatgatccgccacactgggactgagacacggcccagactcctacgggaggcagcagtggggaattttggacaatgggcgcaagcctgatccagccatgccgcgtgagtgaagaaggccttcgggttgtaaagctctttcggccgggaagaaatcgtgttctctaacataggacatggatgacggtaccggactaagaagcaccggctaactacgtgccagcagccgcggtaatacgtagggtgcgagcgttaatcggaattactgggcgtaaagcgtgcgcaggcggttttgtaagacagatgtgaaatccccgggcttaacctgggaactgcgtttgtgactgcaaggctagagtacggcagaggggggtggaattcctggtgtagcagtgaaatgcgtagagatcaggaggaacaccgatggcgaaggcagccccctgggcctgtactgacgctcatgcacgaaagcgtggggagcaaacaggattagataccctggtagtccacgccctaaacgatgtcgactagtcgttcggagcagcaatgcactgagtgacgcagctaacgcgtgaagtcgaccgcctggggagtacggccgcaaggttaaaactcaaaggaattgacggggacccgcacaagcggtggatgatgtggattaattcgatgcaacgcgaaaaaccttacctacccttgacatgtctggaaccttgctgagaggcgagggtgccttcgggagccagaacacaggtgctgcatggctgtcgtcagctcgtgtcgtgagatgttgggttaagtcccgcaacgagcgcaacccttgtcactagttgccatcatttagttgggcactctagtgagactgccggtgacaaaccggaggaaggtggggatgacgtcaagtcctcatggcccttatgggtagggcttcacacgtcatacaatggtcggtacagagggttgccaagccgcgaggtggagccaatcccttaaagccgatcgtagtccggatcgtagtctgcaactcgactacgtgaagtcggaatcgctagtaatcgcagatcagcatgctgcggtgaatacgttcccgggtcttgtacacaccgcccgtcacaccatgggagtgggtttcaccagaagtaggtagcttaaccttcgggagggcgcttaccacggtgagattcatgactggggtgaagtcgtaacaaggtagccgtatcggaaggtgcggctggatcacctcctttc

SEQ ID NO: 9690 - DNA, 1542 bp, Thauera sp. 27
  ref <308>: DATABASE ACCESSION NUMBER: NCBI ACCESSION: NZ_AMXB01000081.1
  ref <309>: DATABASE ENTRY DATE: 2019-04-01
  ref <313>: RELEVANT RESIDUES IN SEQ ID NO: (1)..(1542)
gattgaacttaagagtttgatcctggctcagattgaacgctggcggcatgctttacacatgcaagtcgaacggcagcgggggcttcggcctgccggcgagtggcgaacgggtgagtaatgcatcggaacgtgcccatgtcgtgggggataacgtatcgaaaggtacgctaataccgcatacgtcctgagggagaaagcgggggatcgcaagacctcgcgcgattggagcggccgatgtcggattagctagtaggtgaggtaaaggctcacctaggcgacgatccgtagcgggtctgagaggatgatccgccacactgggactgagacacggcccagactcctacgggaggcagcagtggggaattttggacaatgggggcaaccctgatccagccatgccgcgtgagtgaagaaggccttcgggttgtaaagctctttcggccgggaagaaatcgcgcactctaacatagtgcgtggatgacggtaccggactaagaagcaccggctaactacgtgccagcagccgcggtaatacgtagggtgcgagcgttaatcggaattactgggcgtaaagcgtgcgcaggcggttttgtaagacagatgtgaaatccccgggcttaacctgggaactgcgtttgtgactgcaaggctagagtacggcagaggggggtggaattcctggtgtagcagtgaaatgcgtagatatcaggaggaacaccgatggcgaaggcagccccctgggcctgtactgacgctcatgcacgaaagcgtggggagcaaacaggattagataccctggtagtccacgccctaaacgatgtcgactagtcgttcggagcagcaatgcactgagtgacgcagctaacgcgtgaagtcgaccgcctggggagtacggccgcaaggttaaaactcaaaggaattgacggggacccgcacaagcggtggatgatgtggattaattcgatgcaacgcgaaaaaccttacctacccttgacatgtctggaaccttgctgagaggcgagggtgccttcgggagccagaacacaggtgctgcatggctgtcgtcagctcgtgtcgtgagatgttgggttaagtcccgcaacgagcgcaacccttgtcattagttgccatcatttggttgggcactctaatgagactgccggtgacaaaccggaggaaggtggggatgacgtcaagtcctcatggcccttatgggtagggcttcacacgtcatacaatggtcggtacagagggttgccaagccgcgaggtggagccaatcccttaaagccgatcgtagtccggatcgtagtctgcaactcgactacgtgaagtcggaatcgctagtaatcgcagatcagcatgctgcggtgaatacgttcccgggtcttgtacacaccgcccgtcacaccatgggagtgggtttcaccagaagtaggtagcttaaccttcgggagggcgcttaccacggtgagattcatgactggggtgaagtcgtaacaaggtagccgtatcggaaggtgcggctggatcacctcctttc

SEQ ID NO: 9691 - DNA, 1541 bp, Thauera sp. D20
  ref <308>: DATABASE ACCESSION NUMBER: NCBI ACCESSION: NZ_PZKC01000027.1
  ref <309>: DATABASE ENTRY DATE: 2019-04-01
  ref <313>: RELEVANT RESIDUES IN SEQ ID NO: (1)..(1541)
tgaacttaagagtttgatcctggctcagattgaacgctggcggcatgctttacacatgcaagtcgaacggcagcgggggcttcggcccgccggcgagtggcgaacgggtgagtaatgcatcggaacatgcccagtcgtgggggataactactcgaaagagtagctaataccgcatacgtcctgagggagaaagcgggggatcttcggacctcgtgcgattggagtggccgatgtcggattagctagtaggtggggtaaaggcccacctaggcgacgatccgtagctggtctgagaggatgatcagccacactgggactgagacacggcccagactcctacgggaggcagcagtggggaattttggacaatgggcgcaagcctgatccagccatgccgcgtgagtgaagaaggccttcgggttgtaaagctctttcagtcgggaagaaaaggcgggctctaacatagcccgttgctgacggtaccgacagaagaagcaccggctaactacgtgccagcagccgcggtaatacgtagggtgcgagcgttaatcggaattactgggcgtaaagcgtgcgcaggcggttttgtaagacagatgtgaaatccccgggcttaacctgggaactgcgtttgtgactgcaaggctagagtacggcagaggggggtggaattccacgtgtagcagtgaaatgcgtagatatgtggaggaacaccgatggcgaaggcagccccctgggcctgtactgacgctcatgcacgaaagcgtggggagcaaacaggattagataccctggtagtccacgccctaaacgatgtcaactagtcgttcggagcggtaacgcactgagtgacgcagctaacgcgtgaagttgaccgcctggggagtacggccgcaaggttaaaactcaaaggaattgacggggacccgcacaagcggtggatgatgtggattaattcgatgcaacgcgaaaaaccttacctacccttgacatgccaggaatcttggtgagagccgagagtgccttcgggagcctggacacaggtgctgcatggctgtcgtcagctcgtgtcgtgagatgttgggttaagtcccgcaacgagcgcaacccttgtcactagttgccagcatttagttgggcactctagtgagactgccggtgacaaaccggaggaaggtggggatgacgtcaagtcctcatggcccttatgggtagggcttcacacgtcatacaatggtcggtacagagggttgccaaaccgcgaggtggagccaatcccttaaagccgatcgtagtccggatcgtagtctgcaactcgactacgtgaagtcggaatcgctagtaatcgcggatcagcatgtcgcggtgaatacgttcccgggtcttgtacacaccgcccgtcacaccatgggagtgggtttcaccagaagtaggtagcttaaccttcgggagggcgcttaccacggtgagattcatgactggggtgaagtcgtaacaaggtagccgtaggggaacctgcggctggatcacctcctttcaag

SEQ ID NO: 9692 - DNA, 1544 bp, Thauera sp. MZ1T; identical to SEQ ID NO: 9685
  ref <308>: DATABASE ACCESSION NUMBER: NCBI ACCESSION: NC_011662.2
  ref <309>: DATABASE ENTRY DATE: 2019-04-01
  ref <313>: RELEVANT RESIDUES IN SEQ ID NO: (1)..(1544)

SEQ ID NO: 9693 - DNA, 1544 bp, Thermacetogenium phaeum
  ref <308>: DATABASE ACCESSION NUMBER: NCBI ACCESSION: NZ_KI912609.1
  ref <309>: DATABASE ENTRY DATE: 2019-04-01
  ref <313>: RELEVANT RESIDUES IN SEQ ID NO: (1)..(1544)
tggagagtttgatcctggctcaggacgaacgctggcggcgtgcctaacacatgcaagtcgaacggggtctgtggggggtttttaactttcctgcggacttagtggcggacgggtgagtaacacgtggataacctacctgtaagaccgggataacagcgggaaactgctgctaataccggatagactaatcctggggcatcctggggttaggaaaggggttgaaccgcttacagatgggtccgcggcccattagctagctggtggggtaacggcctaccagggcgacgatgggtagccggcctgagagggtggtcggccacactgggactgagacacggcccagactcctacgggaggcagcagtggggaatcttgcgcaatgggcggaagcctgacgcagcgacgccgcgtgggtgaagaaggcctttgggtcgtaaagccctgttgtacgggacgaagggagtgacggtaccgtacgaggaagccccggctaactacgtgccagcagccgcggtaaaacgtagggggcgagcgttgtccggaattactgggcgtaaagggctcgtaggcggtcattcgagtcatctgtgaaagccgacggctcaaccggaggactgcaggtgatactggatgacttgaggggaggagaggaaggtggaattcccggtgtagcggtgaaatgcgtagatatcgggaggaacaccggtggcgaaggcggccttctggcctctacctgacgctgaggagcgaaagccaggggagcgaacgggattagataccccggtagtcctggccgtaaacgatgggcactaggtgtgggtggtgtgaagccatccgtgccggagctaacgcattaagtgccccgcctggggagtacggccgcaaggttgaaactcaaaggaattgacgggggcccgcacaagcggtggagcatgtggtttaattcgatgcaacgcgaagaaccttaccagggcttgacatctctgcggacctggtggaaacactggggtgccccgagaggggagcgtggagacaggtggtgcatggttgtcgtcagctcgtgtcgtgagatgttgggttaagtcccgcaacgagcgcaacccctacccttagttgccagcatgtttgggtgggcactctaaggggactgccggtgacaaaccggaggaaggtggggatgacgtcaaatcatcatgccctttatgtcctgggctacacacgtgctacaatggccggtacagagggtagcgaacccgtgagggggagccaatcccaaaaagccggtctcagttcggattgcaggctgcaactcgcctgcatgaaggcggaatcgctagtaatcgcggatcagcatgccgcggtgaatacgttcccgggccttgtacacaccgcccgtcacaccacgaaagccggcaacacccgaagccggtggcctaaccccggaaggggagggagccgtcgaaggtggggctggtgattggggtgaagtcgtaacaaggtagccgtatcggaaggtgcggctggatcacctcctttctaaggag

SEQ ID NO: 9694 - DNA, 1559 bp, Thermaerobacter marianensis
  ref <308>: DATABASE ACCESSION NUMBER: NCBI ACCESSION: NC_014831.1
  ref <309>: DATABASE ENTRY DATE: 2019-04-01
  ref <313>: RELEVANT RESIDUES IN SEQ ID NO: (1)..(1559)
ggagagtttgatcctggctcaggacgaacgctggcggcgtgcctaagacatgcaagtcgagcggggagattggggagcttgctctctggtctcctagcggcggacgggtgagtaacacgtgggtaacctgcccggcagtgggggataaccctgggaaactggggctaataccgcatacggtctgcatcccgcatggggtgtggaagaaaggccgtcgtgaggcggtcgctgccggaggggcccgcggcccatcagctcgttggtggggtaacggcccaccaaggcgacgacgggtagccggcctgagagggtggtcggccacactgggactgagacacggcccagactcctacgggaggcagcagtcgggaatcttgcgcaatgggcgaaagcctgacgcagcgacgccgcgtgggggaggaagcccttcggggtgtaaacccctgtcgtccgggacgaaggtggggggttgaaaggccctctgctgacggtaccggaggaggaagccccggctaactacgtgccagcagccgcggtaagacgtagggggcgagcgttgtccggaatcactgggcgtaaagggcgcgtaggcggcctggcaagtcggatgtgaaaggtcccggctcaaccggggaggtgcattcgaaactgccgggcttgagggcaggagagggcagcggaattcccggtggagcggtgaaatgcgtagagatcgggaggaacaccagtggcgaaggcggctgcctggcctggccctgacgctgaggcgcgacagcgtggggagcgaacgggattagataccccggtagtccacgccgtaaaccatgggtgctaggtgtgggaagtatcgaccccttccgtgccggagctaacgcactaagcaccccgccctggggagtacggccgcaaggctgaaactcaaaggaattgacgggggcccgcacaagcggtggagcatgtggtttaattcgaagcaacgcgaagaaccttacctgggcttgacatcaccgcgaacctggccgaaaggctggggtgcccttcggggagcgcggtgacaggtgctgcatggttgtcgtcagctcgtgtcgtgagatgttgggttaagtcccgcaacgagcgcaacccccgccctgtgttgccagcggtacggccgggcactcacaggggactgccggtgacaaaccggaggaaggtggggatgacgtcaaatcatcatggcccttatgcccagggctacacacgtgctacaatggccggtacaacgggttgcgaacccgcgagggggagccaatccctaaaagccggtctcagttcggatcgcaggctgcaactcgcctgcgtgaagccggaatcgctagtaatcgcggatcagaatgccgcggtgaatacgttcccgggccttgtacacaccgcccgtcacaccacgggagccggcaacacccgaagccggtggcccaacccgtaagggagggagccgtcgaaggtggggccggtgactggggtgaagtcgtaacaaggtagccctacgggaacgtggggctggatcacctcctttctaa

SEQ ID NO: 9695 - DNA, 1557 bp, Thermaerobacter sp. PB12 4term
  ref <308>: DATABASE ACCESSION NUMBER: NCBI ACCESSION: NZ_QUWU01000004.1
  ref <309>: DATABASE ENTRY DATE: 2019-04-01
  ref <313>: RELEVANT RESIDUES IN SEQ ID NO: (1)..(1557)
ggagagtttgatcctggctcaggacgaacgctggcggcgtgcctaagacatgcaagtcgagcggggagattggggagcttgctctccggtctcctagcggcggacgggtgagtaacacgtgggcaacctgcccggcagtgggggataaccctgggaaactggggctaataccgcatacggtccgcgctccgcatggggtgtggaagaaaggccgtcggaaggcggtcgctgccggaggggcccgcggcccatcagctagttggtggggtaacggcccaccaaggcgacgacgggtagccggcctgagagggtggccggccacactgggactgagacacggcccagactcctacgggaggcagcagtcgggaatcttgcgcaatgggcgaaagcctgacgcagcgacgccgcgtgggggaggaagcccttcggggtgtaaacccctgtcgtccgggacgaaggtgaggggctgaaaggcctcttgctgacggtaccggaggaggaagccccggctaactacgtgccagcagccgcggtaagacgtagggggcgagcgttgtccggaatcactgggcgtaaagggcgcgtaggcggcctggcaagtcggatgtgaaaggtcccggctcaaccggggaggtgcattcgaaactgccgggcttgagggcaggagagggcagcggaattcccggtggagcggtgaaatgcgtagagatcgggaggaacaccagtggcgaaggcggctgcctggcctggccctgacgctgaggcgcgacagcgtggggagcgaacgggattagataccccggtagtccacgccgtaaacgatgggtgctaggtgtgggaggtatcgaccccttccgtgccggagctaacgcactaagcaccccgcctggggagtacggccgcaaggctgaaactcaaaggaattgacgggggcccgcacaagcggtggagcatgtggtttaattcgaagcaacgcgaagaaccttacctgggcttgacatcaccgcgaacctggccgaaaggccggggtgcccttcggggagcgcggtgacaggtgctgcatggttgtcgtcagctcgtgtcgtgagatgttgggttaagtcccgcaacgagcgcaacccccgccctgtgttgccagcggttcggccgggcactcacaggggactgccggtgacaaaccggaggaaggtggggatgacgtcaaatcatcatggcccttatgcccagggctacacacgtgctacaatggccggtacaacgggttgcgaacccgcgagggggagccaatccctaaaagccggtcccagttcggatcgcaggctgcaactcgcctgcgtgaagccggaatcgctagtaatcgcggatcagaatgccgcggtgaatacgttcccgggccttgtacacaccgcccgtcacaccacgggagctggcaacacccgaagccggtggcccaacccgtcagggagggagccgtcgaaggtggggccggtgactggggtgaagtcgtaacaaggtagccctacgggaacgtggggctggatcacctcctttcta

SEQ ID NO: 9696 - DNA, 1558 bp, Thermaerobacter subterraneus
  ref <308>: DATABASE ACCESSION NUMBER: NCBI ACCESSION: NZ_JH976535.1
  ref <309>: DATABASE ENTRY DATE: 2019-04-01
  ref <313>: RELEVANT RESIDUES IN SEQ ID NO: (1)..(1558)
ggagagtttgatcctggctcaggacgaacgctggcggcgtgcataagacatgcaagtcgagcggggggactggggagcttgctctccggtctcctagcggcggacgggtgagtaacacgtgggcaacctgcccggcagtgggggataaccctgggaaactggggctaataccgcatacggtccgcgctccgcatggggtgtggaagaaaggccgtcgtgaggcggtcgctgccggaggggcccgcggcccatcagctggttggtggggtaacggcccaccaaggcgacgacgggtagccggcctgagagggtggccggccacactgggactgagacacggcccagactcctacgggaggcagcagtcgggaatcttgcgcaatgggcgaaagcctgacgcagcgacgccgcgtgggggaggaagcccttcggggtgtaaacccctgtcgtccgggacgaaggtgaggggctgaaaggcctcttgctgacggtaccggaggaggaagccccggctaactacgtgccagcagccgcggtaagacgtagggggcgagcgttgtccggaatcactgggcgtaaagggcgcgtaggcggcctggcaagtcggatgtgaaaggtcccggctcaaccggggaggtgcattcgaaactgccgggcttgagggcaggagagggcagcggaattcccggtggagcggtgaaatgcgtagagatcgggaggaacaccagtggcgaaggcggctgcctggcctggccctgacgctgaggcgcgacagcgtggggagcgaacgggattagataccccggtagtccacgccgtaaacgatgggtgctaggtgtgggaggtatcgaccccttccgtgccggagctaacgcactaagcaccccgcctggggagtacggccgcaaggctgaaactcaaaggaattgacgggggcccgcacaagcggtggagcatgtggtttaattcgaagcaacgcgaagaaccttacctgggcttgacatcaccgcgaacctggccgaaaggccggggtgcccttcggggagcgcggtgacaggtgctgcatggttgtcgtcagctcgtgtcgtgagatgttgggttaagtcccgcaacgagcgcaacccccgccctgtgttgccagcggcttggccgggcactcacaggggactgccggtgacaaaccggaggaaggtggggatgacgtcaaatcatcatggcccttatgcccagggctacacacgtgctacaatggccggtacaacgggttgcgaacccgcgagggggagccaatccctaaaagccggtcccagttcggatcgcaggctgcaactcgcctgcgtgaagccggaatcgctagtaatcgcggatcagaatgccgcggtgaatacgttcccgggccttgtacacaccgcccgtcacaccacgggagctggcaacacccgaagccggtggcccaacccgaaagggagggagccgtcgaaggtggggccggtgactggggtgaagtcgtaacaaggtagccctacgggaacgtggggctggatcacctcctttctaa

SEQ ID NO: 9697 - DNA, 1566 bp, Thermanaeromonas toyohensis
  ref <308>: DATABASE ACCESSION NUMBER: NCBI ACCESSION: NZ_LT838272.1
  ref <309>: DATABASE ENTRY DATE: 2019-04-01
  ref <313>: RELEVANT RESIDUES IN SEQ ID NO: (1)..(1566)
tatggagggtttgatcctggctcaggacgaacgctggcggcgtgcctaacacatgcaagtcgagcgggccgtagcattaagctggagaggtttagtgttacggtttagcggcggacgggtgagtaacgcgtaggtaacctacccatgagaccgggataaccctgggaaactggggctaatactggatacgctccttttagggcatcctagggggaggaaaggctcttaaggggccgctcatggatgggcctgcgtcccattagctagttggtggggtaatggcctaccaaggctacgatgggtagccggcctgagagggtggtcggccacactgggactgagacacggcccagactcctacgggaggcagcagtgggggatcttgcgcaatgggcgaaagcctgacgcagcgacgccgcgtgggggatgaaggcctttgggttgtaaacccctgtctggagggaagaatggatgacggtacctccggaggaagccccggctaactacgtgccagcagccgcggtaagacgtagggggcgagcgttgtccggaattactgggcgtaaagggcgtgtaggcggtttagcaagtcaggtgtaaaaggctgcggctcaaccgcggttaagcgcctgatactgctggacttgagggcaggagaggggggcggaattcccggtgtagcggtgaaatgcgtagatatcgggaggaacaccagtggcgaaggcggctccctggactggccctgacgctgaggcgcgaaagcgtggggagcaaacaggattagataccctggtagtccacgctgtaaacgatgggtactaggtgttgggggtatcgacccctccagtgccgcagttaacacagtaagtaccccgcctggggagtacggccgcaaggctgaaactcaaaggaattgacgggggcccgcacaagcggtggagcatgtggtttaattcgatgcaacgcgaagaaccttaccagggcttgacatgctggtggtactgacccgaaaggggagggacccttaaggggtagactttaagggagccagcacaggtgctgcatggttgtcgtcagctcgtgtcgtgagatgttgggttaagtcccgcaacgagcgcaacccctacctctagttgccagcgggttaagccgggcactctagagggactgccggcgacaagccggaggaaggtggggatgacgtcaaatcatcatggcccttatgccctgggctacacacgtgctacaatggccggtacagagggtagcgaacctgcgagggggagccaatcccaaaaagccggtctcagttcggattgcaggctgcaactcgcctgcatgaaggcggaatcgctagtaatcgcggatcagccatgccgcggtgaatacgttcccgggccttgtacacaccgcccgtcacaccacgaaagccggcaacacccgaagccggtggagctaaccctggagaagggaggcagccgtcgaaggtggggccggtgattggggtgaagtcgtaacaaggtagccgtacgggaacgtgcggctggatcacctcctttctaagga

SEQ ID NO: 9698 - DNA, 1533 bp, Thermasporomyces composti
  ref <308>: DATABASE ACCESSION NUMBER: NCBI ACCESSION: NZ_QTUC01000001.1
  ref <309>: DATABASE ENTRY DATE: 2019-04-01
  ref <313>: RELEVANT RESIDUES IN SEQ ID NO: (1)..(1533)
gacggagagtttgatcctggctcaggacgaacgctggcggcgtgcttaacacatgcaagtcgtgcggaaaggccccttcgggggtactcgagcggcgaacgggtgagtaacacgtgagtaacctgcccctagctctgggataagcctgggaaactgggtctaataccggatatgacttctgcccgcatgggtgggggtggaaaggtctttgaccggctagggatgggctcgcggcctatcagcttgttggtggggtaatggcctaccaaggctgtgacgggtagccggcctgagagggcgaccggccacactgggactgagacacggcccagactcctacgggaggcagcagtggggaatcttgcgcaatgggcgaaagcctgacgcagcaacgccgcgtgagggatgacggccttcgggttgtaaacctctttcagcggggacgaagcgagagtgacggtacccgcagaagaagcgccggccaactacgtgccagcagccgcggtaatacgtagggcgcgagcgttgtccggaattattgggcgtaaagggctcgtaggcggtgtgtcacgtcgaaagtgaaaatccggagcttaactccggacctgctttcgatacgggcacactagaggtaggcaggggagagtggaattcctggtgtagcggtggaatgcgcagatatcaggaggaacaccggtggcgaaggcggctctctgggccttacctgacgctgaggagcgaaagcgtggggagcgaacaggattagataccctggtagtccacgccgtaaacgttgggcgctaggtgtgggggattttccacgtcctccgtgccgtagctaacgcattaagcgccccgcctggggagtacggccgcaaggctaaaactcaaaggaattgacgggggcccgcacaagcggcggagcatgttgcttaattcgaggcaacgcgaagaaccttacctgggcttgacatgcagggaaaagccgtagagatacggtgtccttcggggccctgcacaggtggtgcatggctgtcgtcagctcgtgtcgtgagatgttgggttaagtcccgcaacgagcgcaacccccgtcctatgttgccagcgggtaatgccgggtactcataggagactgccggggtcaactcggaggaaggtggggatgaggtcaagtcatcatgccccttatgcccagggctgcaaacatgctacaatggccggtacaatgggctgctaaaccgtgaggtggagcgaatcccaaaaagccggcctcagttcggatcggggtctgcaactcgaccccgtgaagtcggagtcgctagtaatcgcggatcagcaacgccgcggtgaatacgttcccgggccttgtacacaccgcccgtcaagtcatgaaagtcggcaacacccgaagccggtgacccaacccctttttggggagggagccgtcgaaggtggggctggcgattaggactaagtcgtaacaaggtagccgtaccggaaggtgcggctggatcacctcctttctaaggagca

SEQ ID NO: 9699 - DNA, 1527 bp, Thermicanus aegyptius
  ref <308>: DATABASE ACCESSION NUMBER: NCBI ACCESSION: NZ_KI783301.1
  ref <309>: DATABASE ENTRY DATE: 2019-04-01
  ref <313>: RELEVANT RESIDUES IN SEQ ID NO: (1)..(1527)
tggagagtttgatcctggctcaggacgaacgctggcggcgtgcctaatacatgcaagtcggacggtttagaagtgagaggcttgcctctcgcttttagacagtggcggacgggtgagtaacacgtaggcaacctgcccgtaataccgggataacctggggaaaccgaggctaagcccggataggctccttttccgcatgggagaggagggaaagggtgcgacccgattacggaggggcctgcggcgcattagctagttggtgaggtaacggcccaccaaggcgatgatgcgtagccgacctgagagggtgaccggccacactgggactgagagacggcccagactcctacgggaggcagcagtagggaatcttcggcaatgggcgaaagcctgaccgagcaacgccgcgtgagtgaggaaggccttcgggttgtaaaactctgttgtttgggaagaagggaaagggtaggccccttaggtgacggtaccaaacgagaaagccccggctaactacgtgccagcagccgcggtaatacgtagggggcgagcgttgtccggaatgattgggcgtaaagcgcgcgcaggcggtcctttaagtctgatgtgaaagcccgcggcttaaccgcggaaggtcattggaaactgggggacttgaggctaggagagggaagtggaattcctggtgtagcggtgaaatgcgtagagatcaggaggaataccgatggcgaaggcagctttctggcctagaactgacgctgaggcgcgaaagcgtggggagcaaacaggattagataccctggtagtccacgccgtaaacgatgagtgctaggtgtgaggggtttcaaggcccttcgtgccgcagtacacacaataagcactccgcctggggagtacggtcgcaagactgaaactcaaaggaattgacgggggcccgcacaagcggtggagcatgtggtttaattcgaagcaacgcgaagaaccttaccagggcttgacatccctctgacgggagtagagatacttcgtcccttcggggcagaggagacaggtggtgcatggttgtcgtcagctcgtgtcgtgagatgttgggttaagtcccgcaacgagcgcaacccttgagcttagttgccagcattcagttgggcactctaggctgactgccgcagacgatgcggaggaaggtggggatgacgtcaaatcatcatgccccttatgtcctgggctacacacgtgctacaatggccggtacagagggaggcgaaggagcgatccggagcggaacccaaaaagccggtcgtagttcggattgcaggctgcaactcgcctgcatgaagtcggaatcgctagtaatcgcggatcagcatgccgcggtgaatccgttcccgggccttgtacacaccgcccgtcacaccacgagagtcggaaacacccgaagtcgctcaggcgcctaaggtggggccgatgattggggtgaagtcgtaacaaggtatccgtaccggaaggtgcggatggatcacctcctttcta

SEQ ID NO: 9700 - DNA, 1620 bp, Thermincola ferriacetica
  ref <308>: DATABASE ACCESSION NUMBER: NCBI ACCESSION: NZ_LGTE01000045.1
  ref <309>: DATABASE ENTRY DATE: 2019-04-01
  ref <313>: RELEVANT RESIDUES IN SEQ ID NO: (1)..(1620)
tggagagtttgatcctggctcaggacgaacgctggcggcgtgcttaacacatgcaagtcgaacgctcctggaggttggaagttagaggttagaagttagattaagaaggaattcgccgaaggcgaattctcacacaatctaacatctaatttccaacttccaacctctaaggggagtggcggacgggtgagtaacgcgtgggcaatctgcccgtaagagggggataacatcgggaaaccggtgctaataccgcataatatctgtataccgcatggtaggcagattaaaggagcgatccgcttacggatgagcccgcgtctgattagctagttggtggggtaacggcctaccaaggcgacgatcagtagccggcctgagagggtgaccggccacactggaactgagacacggtccagactcctacgggaggcagcagtggggaatcttccgcaatgggcgaaagcctgacggagcaacgccgcgtgagcgaagaaggccttcgggttgtaaagctctgtcatcagggaagaagagagtgacggtacctgaggaggaagccacggctaactacgtgccagcagccgcggtaatacgtaggtggcaagcgttgtccggaattactgggcgtaaagagcgcgtaggcgggcgcttaagtcaggggtgaaaactggcagctcaactgccagcctgcctttgagactgggcgtcttgaggacaggagaggagagcggaattcctagtgtagcggtgaaatgcgtagatattaggaggaacaccagtggcgaaggcggctctctggcctgtaactgacgctgaggcgcgaaagcgtggggagcgaacgggattagataccccggtagtccacgccgtaaacgatgggtactaggtgtaggaggtatcgaccccttctgtgccgtagttaacacaataagtaccccgcctggggagtacggccgcaaggttgaaactcaaaggaattgacgggggcccgcacaagcggtggagcatgtggtttaattcgacgcaacgcgaagaaccttaccagggcttgacatcgagggaaggcttgtggaaacacgagtcgtcacaagcttgcttgtgacccgaagacaggtggtgcatggttgtcgtcagctcgtgtcgtgagatgttgggttaagtcccgcaacgagcgcaacccttatctttagttgccagcacgtggaggtgggcactctagagagactgccggtgacaaaccggaggaaggtggggatgacgtcaaatcatcatgccccttatgtcctgggctacacacgtgctacaatggccggtacaaagggaagcgatggggtgacccggagcaaatcccagcaaagccggtctcagttcggattgtagtctgcaactcgactacatgaagtcggaatcgctagtaatcgcaggtcagcatactgcggtgaatacgttcccgggccttgtacacaccgcccgtcacaccacgaaagcctgcaacacccgaagccggtgagctaacccgcaagggaggcagccgtcgaaggtggggccggtgattggggtgaagtcgtaacaaggtagccgtatcggaaggtgcggctggatcacctcctttctaaggag

SEQ ID NO: 9701 - DNA, 1551 bp, Thermoactinomyces daqus
  ref <308>: DATABASE ACCESSION NUMBER: NCBI ACCESSION: NZ_JPST01000070.1
  ref <309>: DATABASE ENTRY DATE: 2019-04-01
  ref <313>: RELEVANT RESIDUES IN SEQ ID NO: (1)..(1551)
tttatcggagagtttgatcctggctcaggatgaacgctggcggcgtgcctaatacatgcaagtcgtgcgggggaagatccttcgggatcggacccagcggcgaacgggtgagtaacacgtgggcaacctgcccgcaagacggggataactccgggaaaccggtgctaatacccgataatcccggctcccgcatgggagcggggtgaaaggcggcttcggctgtcacttgcggatgggcccgcggcgcattagctggttggtgaggtaacggctcaccaaggcgacgatgcgtagccgacctgagagggtgatcggccacactgggactgagacacggcccagactcctacgggaggcagcagtagggaattttccgcaatgggcgcaagcctgacggagcaacgccgcgtgagtgaggacggccttcgggttgtaaaactctgttcttgaggaagaacccttccgaggcgaacagcctcggaagttgacggtactcaaggagaaagccccggctaactacgtgccagcagccgcggtaatacgtagggggcgagcgttatccggaattattgggcgtaaagcgcgcgcaggcggccgattaagtcaggtgtgaaaggctgcggctcaaccgcagagcggcacctgaaactggtcggcttgagtgcaggagaggggagtggaattcccggtgtagcggtggaatgcgtagagatcgggaggaacaccagtggcgaaggcggctctctggcctgtaactgacgctgaggcgcgaaagcgtggggagcaaacaggattagataccctggtagtccacgccgtaaacgatgagtgctaggtgttggggggttccccctcagtgccgaaggtaacccattaagcactccgcctggggagtacggccgcaaggctgaaactcaaaggaattgacgggggcccgcacaagcggtggagcatgtggtttaattcgaagcaacgcgaagaaccttaccagggcttgacatcccgctgaccgctccagagatggagcttcccttcggggcagcggtgacaggtggtgcatggttgtcgtcagctcgtgtcgtgagatgttgggttcagtcccgcaacgagcgcaacccttatcgccagttgccagcatttcggatgggcactctggcgagacagccggtgaaagccggaggaaggtggggatgacgtcaaatcatcatgccccttatgtcctgggctacacacgtgctacaatggccagtacaaagggaagcgaacccgcgagggggagccaatcccaaaaaactggtctcagttcggatcgcaggctgcaactcgcctgcgtgaagccggaatcgctagtaatcgcggatcagcatgccgcggtgaatacgttcccgggccttgtacacaccgcccgtcacaccacgagagtttgcaacacccgaagtcggtgaggcaacccttctgggagccagccgccgaaggtggggcagatgattggggtgaagtcgtaacaaggtatccctaccggaaggtggggatggatcacctcctttctaa

SEQ ID NO: 9702 - DNA, 1554 bp, Thermoactinomyces sp. CDF
  ref <308>: DATABASE ACCESSION NUMBER: NCBI ACCESSION: NZ_LFJU01000020.1
  ref <309>: DATABASE ENTRY DATE: 2019-04-01
  ref <313>: RELEVANT RESIDUES IN SEQ ID NO: (1)..(1554)
ttttttggagagtttgatcctggctcaggatgaacgctggcggcgtgcctaatacatgcaagtcgagcgggagaatcatccttcgggatgaggatccagcggcgaacgggtgagtaacacgtgggcaacctgcccgcaagaccgggataactccgggaaaccggggctaataccggatagtccttttccccgcatggggaaaaggggaaaggcggcttcggctgtcacttgcggatgggcccgcggcgcattagctggttggtgaggtaacggctcaccaaggcgacgatgcgtagccgacctgagagggtgatcggccacactgggactgagacacggcccagactcctacgggaggcagcagtagggaattttccgcaatgggcgaaagcctgacggagcaacgccgcgtgagtgaggacggccttcgggttgtaaaactctgttcttgaggaagaattccttccaggcgaacagcctggaaggttgacggtactcaaggagaaagccccggctaactacgtgccagcagccgcggtaatacgtagggggcgagcgttatccggaattattgggcgtaaagcgcgcgcaggcggctgattaagtcaggtgtgaaaggctgcggctcaaccgcagagcggcacctgaaactggtcagcttgagtgcaggagaggggagcggaattcccggtgtagcggtggaatgcgtagagatcgggaggaacaccagtggcgaaggcggctctctggcctgtaactgacgctgaggcgcgaaagcgtggggagcaaacaggattagataccctggtagtccacgccgtaaacgatgagtgctaggtgttggggggctacgcccctcagtgccgaaggtaacccattaagcactccgcctggggagtacggccgcaaggctgaaactcaaaggaattgacgggggcccgcacaagcggtggagcatgtggtttaattcgaagcaacgcgaagaaccttaccagggcttgacatcccgctgacccctccagagatggaggtttccttcgggacagcggtgacaggtggtgcatggttgtcgtcagctcgtgtcgtgagatgttgggttcagtcccgcaacgagcgcaacccttgtcgttagttgccagcatttcggatgggcactctaacgagacagccggtgaaagccggaggaaggtggggatgacgtcaaatcatcatgccccttatgtcctgggctacacacgtgctacaatggctggtacaaagggcagcgaacccgcgagggggagccaatcccaaaaagccagtctcagttcggatcgcaggctgcaactcgcctgcgtgaagccggaatcgctagtaatcgcggatcagcatgccgcggtgaatacgttcccgggccttgtacacaccgcccgtcacaccacgagagtttgcaacacccgaagtcggtgaggcaaccttttaggagccagccgccgaaggtggggcagatgattggggtgaagtcgtaacaaggtatccctaccggaaggtggggatggatcacctcctttctaa

SEQ ID NO: 9703 - DNA, 289 bp, Thermoactinomyces sp. DSM 45891
  ref <308>: DATABASE ACCESSION NUMBER: NCBI ACCESSION: NZ_FPJZ01000017.1
  ref <309>: DATABASE ENTRY DATE: 2019-04-01
  ref <313>: RELEVANT RESIDUES IN SEQ ID NO: (1)..(289)
atggagagtttgatcctggctcaggacgaacgctggcggcgtgcctaatacatgcaagtcgagcgaggagcttttagctcctagcggcgaacgggtgagtaacacgtgggcaacctgcccgtaagactgggataacttcgggaaaccggagctaatactggataatcttgatcttcgcatgaaggacaagtaaaagatttatcacttacggatgggcccgcggtgcattagcttgttggtagggtaatggcctaccaaggcgacgatgcatagccgacctgagagggtg

SEQ ID NO: 9704 - DNA, 1554 bp, Thermoactinomyces sp. Gus2-1
  ref <308>: DATABASE ACCESSION NUMBER: NCBI ACCESSION: NZ_JPZM01000030.1
  ref <309>: DATABASE ENTRY DATE: 2019-04-01
  ref <313>: RELEVANT RESIDUES IN SEQ ID NO: (1)..(1554)
ttttttggagagtttgatcctggctcaggatgaacgctggcggcgtgcctaatacatgcaagtcgagcgggagaatcatccttcgggatgaggatccagcggcgaacgggtgagtaacacgtgggcaacctgcccgcaagactgggataactccgggaaaccggggctaataccggataggccatttccccgcatggggaaatggggaaaggcggcttcggctgtcacttgcggatgggcccgcggcgcattagctggttggtgaggtaacggctcaccaaggcgacgatgcgtagccgacctgagagggtgatcggccacactgggactgagacacggcccagactcctacgggaggcagcagtagggaattttccgcaatgggcgaaagcctgacggagcaacgccgcgtgagtgaggacggccttcgggttgtaaaactctgttcttgaggaagaattccttccaggcgaacagcctggaaggttgacggtactcaaggagaaagccccggctaactacgtgccagcagccgcggtaatacgtagggggcgagcgttatccggaattattgggcgtaaagcgcgcgcaggcggctgattaagtcaggtgtgaaaggctgcggctcaaccgcagagcggcacctgaaactggtcagcttgagtgcaggagaggggagcggaattcccggtgtagcggtggaatgcgtagagatcgggaggaacaccagtggcgaaggcggctctctggcctgtaactgacgctgaggcgcgaaagcgtggggagcaaacaggattagataccctggtagtccacgccgtaaacgatgagtgctaggtgttggggggctacgcccctcagtgccgaaggtaacccattaagcactccgcctggggagtacggccgcaaggctgaaactcaaaggaattgacgggggcccgcacaagcggtggagcatgtggtttaattcgaagcaacgcgaagaaccttaccagggcttgacatcccgctgacccctccagagatggaggtttccttcgggacagcggtgacaggtggtgcatggttgtcgtcagctcgtgtcgtgagatgttgggttcagtcccgcaacgagcgcaacccttgtcgttagttgccagcatttcggatgggcactctaacgagacagccggtgaaagccggaggaaggtggggatgacgtcaaatcatcatgccccttatgtcctgggctacacacgtgctacaatggctggtacaaagggcagcgaacccgcgagggggagccaatcccaaaaagccagtctcagttcggatcgcaggctgcaactcgcctgcgtgaagccggaatcgctagtaatcgcggatcagcatgccgcggtgaatacgttcccgggccttgtacacaccgcccgtcacaccacgagagtttgcaacacccgaagtcggtgaggcaaccttttaggagccagccgccgaaggtggggcagatgattggggtgaagtcgtaacaaggtatccctaccggaaggtggggatggatcacctcctttctaa

SEQ ID NO: 9705 - DNA, 1546 bp, Thermoactinomycetaceae bacterium SCSIO 07575
  ref <308>: DATABASE ACCESSION NUMBER: NCBI ACCESSION: NZ_CP034118.1
  ref <309>: DATABASE ENTRY DATE: 2019-04-01
  ref <313>: RELEVANT RESIDUES IN SEQ ID NO: (1)..(1546)
tggagagtttgatcctggctcaggatgaacgctggcggcgtgcctaatacatgcaagtcgagcggtccttccttcgggaagggcagcggcgaacgggtgagtaacacgtgggcaacctgcccgcaagaccgggataacttcgggaaaccggagctaataccggatacgctcatccgccgcatggcggatgagggaaaggcggcttcggctgtcacttgcggatgggcccgcggcgcattagcttgttggtgaggtaacggctcaccaaggcgacgatgcgtagccgacctgagagggtgatcggccacactgggactgagacacggcccagactcctacgggaggcagcagtagggaattttccgcaatgggcgaaagcctgacggagcaacgccgcgtgagtgaggacggccttcgggttgtaaaactctgttcttggggaagaaactccgggaggcgaataacttcccggcatgacggtacccaaggagaaagccccggctaactacgtgccagcagccgcggtaatacgtagggggcgagcgttatccggaattactgggcgtaaagcgcgcgcaggcggccggttaagtcgggtgtgaaaggctgcggctcaaccgcagagcggcacccgaaactggcgggcttgagtgcaggagagggaagcggaattcccggtgtagcggtggaatgcgtagagatcgggaggaacaccagtggcgaaggcggcttcctggcctgtaactgacgctgaggcgcgaaagcgtggggagcaaacaggattagataccctggtagtccacgccgtaaacgatgagtgctaggtgttgggggactcgcgccctcagtgccgaaggtaacccattaagcactccgcctggggagtacggccgcaaggctgaaactcaaaggaattgacgggggcccgcacaagcggtggagcatgtggtttaattcgaagcaacgcgaagaaccttaccagggcttgacatcccgctgaccggtgcagagatgcgcctttccttcgggacagcggtgacaggtggtgcatggttgtcgtcagctcgtgtcgtgagatgttgggttcagtcccgcaacgagcgcaacccttgctctcagttgccagcacctcgggtgggcactctggggggacagccggtgaaagccggaggaaggtggggatgacgtcaaatcatcatgccccttatgtcctgggctacacacgtgctacaatggccggtacaaagggctgcgaacccgcgagggggagccaatcccaaaaaaccggtctcagttcggatcgcaggctgcaactcgcctgcgtgaagccggaatcgctagtaatcgcggatcagcatgccgcggtgaatacgttcccgggccttgtacacaccgcccgtcacaccacgagagtttgcaacacccgaagtcggtgaggcaacccgcaagggagccagccgccgaaggtggggcagatgattggggtgaagtcgtaacaaggtatccctaccggaaggtggggatggatcacctcctttctaaggag

SEQ ID NO: 9706 - DNA, 1790 bp, Thermoanaerobacter brockii
  ref <308>: DATABASE ACCESSION NUMBER: NCBI ACCESSION: NC_014964.1
  ref <309>: DATABASE ENTRY DATE: 2019-04-01
  ref <313>: RELEVANT RESIDUES IN SEQ ID NO: (1)..(1790)
gaacctgagagtttgatcctggctcaggacgaacgctggcggcgtgcctaacacatgcaagtcgagcggtccggcactcaactaagtgcttacttaaggggaaggaagtatagtagaagaagaaagtaataaaagtggtgcaaagtaaggtaagcacggagttgagtgccggatagcggcggacgggtgagtaacgcgtgggcaacctacccttaagaccgggataacacctcgaaaggggtgctaatactggataagctccttgtagggcatcctatgaggagggaaggtagcgggagctaccgcttaaggatgggcccgcgtcccatcagctagttggtagggtaacggcctaccaaggcgacgacgggtagccggcctgagagggtggtcggccacactgggactgagacacggcccagactcctacgggaggcagcagtggggaatcttgcgcaatgggcgaaagcctgacgcagcgacgccgcgtgagcgaagaaggccttcgggtcgtaaagctcgatagtgtgggaagaatagatgacggtaccacacgaaagccccggctaactacgtgccagcagccgcggtaagacgtagggggcgagcgttgtccggaattactgggcgtaaagggcgcgtaggcggccgttcaagtcaggtgtaaaaaacccgggctcaacccgggggatgcacatgaaactgggtggctagagggcaggagaggggagtggaattcccggtgtagcggtgaaatgcgtagatatcgggaggaataccagtggcgaaggcgactctctggactgaccctgacgctgaggcgcgaaagcgtggggagcaaacaggattagataccctggtagtccacgccgtaaacgatgggtactaggtgtgggatgcggaagcattccgtgccgtagttaacgcaataagtaccccgcctggggagtacggccgcaaggttgaaactcaaaggaattgacgggggcccgcacaagcggtggagcatgtggtttaattcgaagcaacgcgaagaaccttaccagggcttgacatgcaggtagtagcgagccgaaaggtgagcgacccggcactcaagtgggcatgatagagaaggtagtaagagggagaatgaagtgcctacttgagtgccgggagcctgcacaggtggtgcatggttgtcgtcagctcgtgtcgtgagatgttgggttaagtcccgcaacgagcgcaacccttgcttctagttgccagtccgtcactcaactgaacatgttaggaaagagtagagaggaagggatagcgtgttcagttgagtgacggaggcactctagagggactgccgtggacaacacggaggaaggtggggatgacgtcaaatcatcatgccctatatgccctgggccacacacgtgctacaatggccggtacagagggaggcgaaggagcgatctggagcggaacccaaaaagccggtccaagttcggattgcaggctgcaactcgcctgcatgaagtcggaatcgctagtaatcgcggatcagcatgccgcggtgaatacgttcccgggccttgtacacaccgcccgtcacaccacgagagtctgcaacacccgaagccggtgacccaacccggcactcaagtgggcatgttagaaacgtgatgaagagaaaaaaacgtgcccacttgagtgccgggggggagccgtcgaaggtggggcagatgattggggtgaagtcgtaacaaggtagccgtatcggaaggtgcggctggatcacctcctttctaaggaga

SEQ ID NO: 9707 - DNA, 1780 bp, Thermoanaerobacter indiensis
  ref <308>: DATABASE ACCESSION NUMBER: NCBI ACCESSION: NZ_KB910517.1
  ref <309>: DATABASE ENTRY DATE: 2019-04-01
  ref <313>: RELEVANT RESIDUES IN SEQ ID NO: (1)..(1780)
gctgagagtttgatcctggctcaggacgaacgctggcggcgtgcctaacacatgcaagtcgagcggtccggcactcaactaagtgcttacttaaggggaaggaagtatagtagaagaagaaagtaataaaagtggtgcaaagtaaggtaagcacggagttgagtgccggatagcggcggacgggtgagtaacgcatgggcaacctacccttaagaccgggataacacctcgaaaggggtgctaatactggataagctccttgtagggcatcctatgaggagggaaggtagcggaagctaccgcttaaggatgggcccgcgtcccatcagctagttggtagggtaacggcctaccaaggcgacgacgggtagccggcctgagagggtggtcggccacactgggactgagacacggcccagactcctacgggaggcagcagtggggaatcttgcgcaatgggcgaaagcctgacgcagcgacgccgcgtgagcgaagaaggccttcgggtcgtaaagctcgatagtgtgggaagaatagatgacggtaccacacgaaagccccggctaactacgtgccagcagccgcggtaagacgtagggggcgagcgttgtccggaattactgggcgtaaagggcgcgtaggcggccacttaagtcaggtgtaaaaaacccgggctcaacccgggggatgcacatgaaactgggtggctagagggcaggagaggggagtggaattcccggtgtagcggtgaaatgcgtagatatcgggaggaataccagtggcgaaggcgactctctggactgaccctgacgctgaggcgcgaaagcgtggggagcaaacaggattagataccctggtagtccacgccgtaaacgatgggtactaggtgtgggatgcggaagcattccgtgccgtagttaacgcaataagtaccccgcctggggagtacggccgcaaggttgaaactcaaaggaattgacgggggcccgcacaagcggtggagcatgtggtttaattcgaagcaacgcgaagaaccttaccagggcttgacatgcaggtagtagcgagccgaaaggtgagcgacccggcactcaagtgggcatgatagagaaggtagtaagagggagaatgaagtgcctacttgagtgccgggagcctgcacaggtggtgcatggttgtcgtcagctcgtgtcgtgagatgttgggttaagtcccgcaacgagcgcaacccttgcttctagttgccagtccgtcactcaactgaacatgttaggaaagagtagagaggaagggatagcgtgttcagttgagtgacggaggcactctagagggactgccgtggacaacacggaggaaggtggggatgacgtcaaatcatcatgccctatatgccctgggccacacacgtgctacaatggccggtacagagggaggcgaagccgcgaggcggagcggaacccaaaaagccggtccaagttcggattgcaggctgcaactcgcctgcatgaagtcggaatcgctagtaatcgcggatcagcatgccgcggtgaatacgttcccgggccttgtacacaccgcccgtcacaccacgagagtctgcaacacccgaagccggtgacccaacccggcactcaagtgggcatgttagaaacgtgatgaagagaaaaaaacgtgcccacttgagtgccgggggggagccgtcgaaggtggggcagatgattggggtgaagtcgtaacaaggtagccgtatcggaaggtgcggctggatcacctcctttct

SEQ ID NO: 9708 - DNA, 1603 bp, Thermoanaerobacter italicus
  ref <308>: DATABASE ACCESSION NUMBER: NCBI ACCESSION: NC_013921.1
  ref <309>: DATABASE ENTRY DATE: 2019-04-01
  ref <313>: RELEVANT RESIDUES IN SEQ ID NO: (1)..(1603)
gagagtttgatcctggctcaggacgaacgctggcggcgtgcctaacacatgcaagtcgagcggtccggcactcaacgtagttgagtggcggatagcggcggacgggtgagtaacgcgtgggcaacctacccttaagactgggatagcacctcgaaaggggtggtaatactggataagctccttatagggcatcctatggggaggaaagggtagcgaaagctaccgcttaaggatgggcccgcgtcccatcagctagttggtagggtaacggcctaccaaggcgacgacgggtagccggcctgagagggtggtcggccacactgggactgagacacggcccagactcctacgggaggcagcagtggggaatcttgggcaatgggcggaagcctgacccagcgacgccgcgtgggggaggaaggccttcgggttgtaaaccccagtagtgtgggaagaagtggtgacggtaccacacgaaagccccggctaactacgtgccagcagccgcggtaagacgtagggggcgagcgttgtccggaattactgggcgtaaagggcgcgtaggcggtcaatcaagtcaggtgtaaaagacccgggctcaacccgggggtagcacctgaaactggttggctagagggcaggagaggggagtggaattcccggtgtagcggtgaaatgcgtagatatcgggaggaataccagtggcgaaggcgactctctggactggccctgacgctgaggcgcgaaagcgtggggagcgaacaggattagataccctggtagtccacgctgtaaacgatgggtactaggtgtggggcgcggaagcgttccgtgccgtagcgaacgcaataagtaccccgcctggggagtacggccgcaaggttgaaactcaaaggaattgacgggggcccgcacaagcggtggagcatgtggtttaattcgaagcaacgcgaagaaccttaccagggcttgacatgcaggtggtagcgaaccgaaaggtaagcgaccttaccggggggtaaggagcctgcacaggtggtgcatggttgtcgtcagctcgtgtcgtgagatgttgggttaagtcccgcaacgagcgcaacccctgcctctagttgccagcgggtgaagccgggcactctagggggactgccgtggaggacacggaggaaggtggggatgacgtcaaatcatcatgccctaaatgccctgggccacacacgtgctacaatggccggtacagagggatgcgaaggagcgatctggagcgaatcccaaaaagccggtccaagttcggattgcaggctgcaactcgcctacatgaagtcggaatcgctagtaatcgcggatcagcatgccgcggtgaatacgttcccgggccttgtacacaccgcccgtcacaccacgagagcctgcgacacccgaagccggtgacccaacccggcactcaagtggacatgggattatagggaagaaagaagatataatacgtgtccacttgagtgccgggagggagccgtcgaaggtggggcaggtgattggggtgaagtcgtaacaaggtagccgtatcggaaggtgcggctggatcacctcctttctaaggaga

SEQ ID NO: 9709 - DNA, 1666 bp, Thermoanaerobacter kivui
  ref <308>: DATABASE ACCESSION NUMBER: NCBI ACCESSION: NZ_CP009170.1
  ref <309>: DATABASE ENTRY DATE: 2019-04-01
  ref <313>: RELEVANT RESIDUES IN SEQ ID NO: (1)..(1666)
gagagtttgatcctggctcaggacgaacgctggcggcgtgcctaacacatgcaagtcgagcggtccggcactcaactaagtgcttacttaaggggaagaagtataggagaagaagaaagaaataaaagtggagcaaagtaaggtaagcacggagttgagtgccggatagcggcggacgggtgagtaacgcgtgggcaacctacccttcagactgggataacacctcgaaaggggtgctaataccggatgaggtcataaggtggcatcaccttatgaagaaagggggtaaaacccgctgaaggatgggcccgcgtcccatcagctagttggtagggtaatggcctaccaaggctacgacgggtagccggcctgagagggtggtcggccacactgggactgagacacggcccagactcctacgggaggcagcagtggggaatcttgcgcaatgggcgaaagcctgacgcagcgacgccgcgtgagcgaggaaggccttcgggtcgtaaagctcgatagtgtgggaagaagggatgacggtaccacacgaaagccccggctaactacgtgccagcagccgcggtaagacgtagggggcgagcgttgtccggaattactgggcgtaaagggcgcgtaggcggtcacttaagtcaggtgtaaaatacccgggctcaacctgggggtagcacttgaaactgggtggctagagggcaggagaggggagtggaattcccggtgtagcggtgaaatgcgtagatatcgggaggaataccagtggcgaaggcgactctctggactgaccctgacgctgaggcgcgaaagcgtggggagcaaacaggattagataccctggtagtccacgctgtaaacgatgggtactaggtgtgggatgcggaagcattccgtgccgtagttaacgcaataagtaccccgcctggggagtacggccgcaaggttgaaactcaaaggaattgacgggggcccgcacaagcggtggagcatgtggtttaattcgaagcaacgcgaagaaccttaccagggcttgacatgcaggtagtagcgagccgaaaggtgagcgacctcaccttaaaggtgaggagcctgcacaggtggtgcatggttgtcgtcagctcgtgtcgtgagatgttgggttaagtcccgcaacgagcgcaacccctgcttctagttgccagcgggtgaagccgggcactctagagggactgccgtggacaacacggaggaaggtggggatgacgtcaaatcatcatgccctatatgccctgggccacacacgtgctacaatggccggtacagagggaggcgaagccgcgaggtggagcggaacccaaaaagccggtccaagttcggattgcaggctgcaactcgcctgcatgaagtcggaatcgctagtaatcgcggatcagcatgccgcggtgaatacgttcccgggccttgtacacaccgcccgtcacaccacgagagtctgcaacacccgaagccggtgacccaacccggcactcaagtgggcatgttaggaaaggtaggaagaggaagaatgatgtgcccacttgagtgccgggagggagccgtcgaaggtggggcagatgattggggtgaagtcgtaacaaggtagccgtatcggaaggtgcggctggatcacctcctttct

SEQ ID NO: 9710 - DNA, 1542 bp, Thermoanaerobacter mathranii
  ref <308>: DATABASE ACCESSION NUMBER: NCBI ACCESSION: NC_014209.1
  ref <309>: DATABASE ENTRY DATE: 2019-04-01
  ref <313>: RELEVANT RESIDUES IN SEQ ID NO: (1)..(1542)
ctgagagtttgatcctggctcaggacgaacgctggcggcgtgcctaacacatgcaagtcgagcggtccggcactcaacgtagttgagtggcggatagcggcggacgggtgagtaacgcgtgggcaacctacccttaagaccgggatagcacctcgaaaggggtggtaatactggataagctccttatagggcatcctatagggaggaaagggaagcgcaagctaccgcttaaggatgggcccgcgtcccatcagctagttggtagggtaacggcctaccaaggcgacgacgggtagccggcctgagagggtggtcggccacactgggactgagacacggcccagactcctacgggaggcagcagtggggaatcttgggcaatgggcggaagcctgacccagcgacgccgcgtgggggaggaaggccttcgggttgtaaaccccgttagtgtgggaagaagggatgacggtaccacacgaaagccccggctaactacgtgccagcagccgcggtaagacgtagggggcgagcgttgtccggaattactgggcgtaaagggcgcgtaggcggtcaatcaagtcaggtgtaaaagacccgggctcaacccgggggtagcatctgaaactgattggctagagggcaggagaggggagtggaattcccggtgtagcggtgaaatgcgtagatatcgggaggaataccagtggcgaaggcgactctctggactggccctgacgctgaggcgcgaaagcgtggggagcgaacaggattagataccctggtagtccacgctgtaaacgatgggtactaggtgtggggcgcggaagcgttccgtgccgtagcgaacgcaataagtaccccgcctggggagtacggccgcaaggttgaaactcaaaggaattgacgggggcccgcacaagcggtggagcatgtggtttaattcgaagcaacgcgaagaaccttaccagggcttgacatgcaggtagtagcgaaccgaaaggggagcgaccttaccgggaggtaaggagcctgcacaggtggtgcatggttgtcgtcagctcgtgtcgtgagatgttgggttaagtcccgcaacgagcgcaacccctgcctctagttgccagcgggtaagccgggcactctagggggactgccgtggaggacacggaggaaggtggggatgacgtcaaatcatcatgccctaaatgccctgggccacacacgtgctacaatggccggtacagaggggagcgaagccgtgaggcggagcgaatcccaaaaagccggtccaagttcggattgcaggctgcaactcgcctgcatgaagtcggaatcgctagtaatcgcggatcagcatgccgcggtgaatacgttcccgggccttgtacacaccgcccgtcacaccacgagagcctgcgacacccgaagccggtgacccaaccgggaaggagggagccgtcgaaggtggggcaggtgattggggtgaagtcgtaacaaggtagccgtatcggaaggtgcggctggatcacctcctttctaaggaga

SEQ ID NO: 9711 - DNA, 1790 bp, Thermoanaerobacter pseudethanolicus; identical to SEQ ID NO: 9706
  ref <308>: DATABASE ACCESSION NUMBER: NCBI ACCESSION: NC_010321.1
  ref <309>: DATABASE ENTRY DATE: 2019-04-01
  ref <313>: RELEVANT RESIDUES IN SEQ ID NO: (1)..(1790)

SEQ ID NO: 9712 - DNA, 1602 bp, Thermoanaerobacter siderophilus
  ref <308>: DATABASE ACCESSION NUMBER: NCBI ACCESSION: NZ_CM001486.1
  ref <309>: DATABASE ENTRY DATE: 2019-04-01
  ref <313>: RELEVANT RESIDUES IN SEQ ID NO: (1)..(1602)
gctgagagtttgatcctggctcaggacgaacgctggcggcgtgcctaacacatgcaagtcgagcgattcagaggtcggaaatcgacttccgacttccgacctctggatagcggcggacgggtgagtaacgcgtgggcaacctacccttaagaccgggataacacctcgaaaggggtgctaatactggataagctccttgtagggcatcctatggggagggaaggtagcggaagctaccgcttaaggatgggcccgcgtcccatcagctagttggtggggtaacggcctaccaaggcgacgacgggtagccggcctgagagggtgatcggccacactgggactgagacacggcccagactcctacgggaggcagcagtggggaatcttgcgcaatgggcgaaagcctgacgcagcgacgccgcgtgagcgaagaaggccttcgggtcgtaaagctcgatagtgtgggaagaatagatgacggtaccacacgaaagccccggctaactacgtgccagcagccgcggtaagacgtagggggcgagcgttgtccggaattactgggcgtaaagggcgcgtaggcggccacttaagtcaggtgtaaaaaaacccgggctcaacccgggggatgcacatgaaactgggtggctagagggcaggagaggggagtggaattcccggtgtagcggtgaaatgcgtagatatcgggaggaataccagtggcgaaggcgactctctggactgacactgacgctgaggcgcgaaagcgtggggagcaaacaggattagataccctggtagtccacgccgtaaacgatgggtactaggtgtgggatgcggaagcattccgtgccgtagctaacgcattaagtaccccgcctggggagtacggccgcaaggctgaaactcaaaggaattgacgggggcccgcacaagcggtggagcatgtggtttaattcgaagcaacgcgaagaaccttaccagggcttgacatgcaggtagtagcgagccgaaaggtgagcgacccggcactcaagtgggcatgatagagaaggtagtaagagggagaatgaagtgcctacttgagtgccgggagcctgcacaggtggtgcatggttgtcgtcagctcgtgtcgtgagatgttgggttaagtcccgcaacgagcgcaacccttgcttctagttgccatcggggaaagccgggcactctagagggactgccgtggacaacacggaggaaggtggggatgacgtcaaatcatcatgccctatatgccctgggccacacacgtgctacaatggccggtacagagggaggcgaagccgcgaggcggagcggaacccaaaaagccggtcccagttcggattgcaggctgcaactcgcctgcatgaaggcggaatcgctagtaatcgcggatcagcatgccgcggtgaatacgttcccgggccttgtacacaccgcccgtcacaccacgaaagtctgcaacacccgaagccggtgacccaaccgggaaggggggagccgtcgaaggtggggcagatgattggggtgaagtcgtaacaaggtagccgtatcggaaggtgcggctggatcacctcctttcta

SEQ ID NO: 9713 - DNA, 1548 bp, Thermoanaerobacter sp. X513
  ref <308>: DATABASE ACCESSION NUMBER: NCBI ACCESSION: NC_014538.1
  ref <309>: DATABASE ENTRY DATE: 2019-04-01
  ref <313>: RELEVANT RESIDUES IN SEQ ID NO: (1)..(1548)
gaacctgagagtttgatcctggctcaggacgaacgctggcggcgtgcctaacacatgcaagtcgagcggtccggcagccaacttaagttgggagccggatagcggcggacgggtgagtaacgcgtgggcaacctacccttaagaccgggataacacctcgaaaggggtgctaatactggataagctccttgtagggcatcctatgaggagggaaggtagcgggagctaccgcttaaggatgggcccgcgtcccatcagctagttggtagggtaacggcctaccaaggcgacgacgggtagccggcctgagagggtggtcggccacactgggactgagacacggcccagactcctacgggaggcagcagtggggaatcttgcgcaatgggcgaaagcctgacgcagcgacgccgcgtgagcgaggaaggccttcgggtcgtaaagctcgatagtgtgggaagaagggatgacggtaccacacgaaagccccggctaactacgtgccagcagccgcggtaagacgtagggggcgagcgttgtccggaattactgggcgtaaagggcgcgtaggcggccgttcaagtcaggtgtaaaatacccgggctcaacccggggatagcacttgaaactgggcggctagagggcaggagaggggagtggaattcccggtgtagcggtgaaatgcgtagatatcgggaggaataccagtggcgaaggcgactctctggactgaccctgacgctgaggcgcgaaagcgtggggagcaaacaggattagataccctggtagtccacgccgtaaacgatgggtactaggtgtgggatgcggaagcattccgtgccgtagttaacgcaataagtaccccgcctggggagtacggccgcaaggttgaaactcaaaggaattgacgggggcccgcacaagcggtggagcatgtggtttaattcgaagcaacgcgaagaaccttaccagggcttgacatgcaggtagtagcgagccgaaaggtgagcgacctcaccttaaaggtgaggagcctgcacaggtggtgcatggttgtcgtcagctcgtgtcgtgagatgttgggttaagtcccgcaacgagcgcaacccctgcctctagttgccagcgggtgaagccgggcactctagagggactgccgtggacaacacggaggaaggtggggatgacgtcaaatcatcatgccctatatgccctgggccacacacgtgctacaatggccggtacagagggaagcgaagccgcgaggtggagcgaaacccaaaaagccggtccaagttcggattgcaggctgcaactcgcctgcatgaagtcggaatcgctagtaatcgcggatcagcatgccgcggtgaatacgttcccgggccttgtacacaccgcccgtcacaccacgagagtctgcaacacccgaagccggtgacccaaccgggaaggagggagccgtcgaaggtggggcagatgattggggtgaagtcgtaacaaggtagccgtatcggaaggtgcggctggatcacctcctttctaaggaga

SEQ ID NO: 9714 - DNA, 1548 bp, Thermoanaerobacter sp. X514
  ref <308>: DATABASE ACCESSION NUMBER: NCBI ACCESSION: NC_010320.1
  ref <309>: DATABASE ENTRY DATE: 2019-04-01
  ref <313>: RELEVANT RESIDUES IN SEQ ID NO: (1)..(1548)
gaacctgagagtttgatcctggctcaggacgaacgctggcggcgtgcctaacacatgcaagtcgagcggtccggcagccaacttaagttgggagccggatagcggcggacgggtgagtaacgcgtgggcaacctacccttaagaccgggataacacctcgaaaggggtgctaatactggataagctccttgtagggcatcctatgaggagggaaggtagcgggagctaccgcttaaggatgggcccgcgtcccatcagctagttggtagggtaacggcctaccaaggcgacgacgggtagccggcctgagagggtggtcggccacactgggactgagacacggcccagactcctacgggaggcagcagtggggaatcttgcgcaatgggcgaaagcctgacgcagcgacgccgcgtgagcgaggaaggccttcgggtcgtaaagctcgatagtgtgggaagaagggatgacggtaccacacgaaagccccggctaactacgtgccagcagccgcggtaagacgtagggggcgagcgttgtccggaattactgggcgtaaagggcgcgtaggcggccgttcaagtcaggtgtaaaatacccgggctcaacccggggatagcacttgaaactgggcggctagagggcaggagaggggagtggaattcccggtgtagcggtgaaatgcgtagatatcgggaggaataccagtggcgaaggcgactctctggactgaccctgacgctgaggcgcgaaagcgtggggagcaaacaggattagataccctggtagtccacgccgtaaacgatgggtactaggtgtgggatgcggaagcattccgtgccgtagttaacgcaataagtaccccgcctggggagtacggccgcaaggttgaaactcaaaggaattgacgggggcccgcacaagcggtggagcatgtggtttaattcgaagcaacgcgaagaaccttaccagggcttgacatgcaggtagtagcgagccgaaaggtgagcgaccttaccttaaaggtgaggagcctgcacaggtggtgcatggttgtcgtcagctcgtgtcgtgagatgttgggttaagtcccgcaacgagcgcaacccctgcctctagttgccagcgggtgaagccgggcactctagagggactgccgtggacaacacggaggaaggtggggatgacgtcaaatcatcatgccctatatgccctgggccacacacgtgctacaatggccggtacagagggaagcgaagccgcgaggtggagcgaaacccaaaaagccggtccaagttcggattgcaggctgcaactcgcctgcatgaagtcggaatcgctagtaatcgcggatcagcatgccgcggtgaatacgttcccgggccttgtacacaccgcccgtcacaccacgagagtctgcaacacccgaagccggtgacccaaccgggaaggagggagccgtcgaaggtggggcagatgattggggtgaagtcgtaacaaggtagccgtatcggaaggtgcggctggatcacctcctttctaaggaga

SEQ ID NO: 9715 - DNA, 1548 bp, Thermoanaerobacter sp. X561; identical to SEQ ID NO: 9714
  ref <308>: DATABASE ACCESSION NUMBER: NCBI ACCESSION: NZ_ACXP02000002.1
  ref <309>: DATABASE ENTRY DATE: 2019-04-01
  ref <313>: RELEVANT RESIDUES IN SEQ ID NO: (1)..(1548)

SEQ ID NO: 9716 - DNA, 1700 bp, Thermoanaerobacter sp. YS13
  ref <308>: DATABASE ACCESSION NUMBER: NCBI ACCESSION: NZ_JOOI01000002.1
  ref <309>: DATABASE ENTRY DATE: 2019-04-01
  ref <313>: RELEVANT RESIDUES IN SEQ ID NO: (1)..(1700)
tgagagtttgatcctggctcaggacgaacgctggcggcgtgcctaacacatgcaagtcgagcggttcggcacttggcgcaagttaagtgtcggatagcggcggacgggtgagtaacgcgtgggcaacctacccttaagaccgggataacacctcgaaaggggtgctaatactggataaggtcataaggtggcatcaccatatgaagaaagggggaacccgcttaaggatgggcccgcgtcccatcagctagttggtgaggtaacggctcaccaaggcgacgacgggtagccggcctgagagggtggtcggccacactgggactgagacacggcccagactcctacgggaggcagcagtggggaatcttgcgcaatgggcgaaagcctgacgcagcgacgccgcgtgagcgaggaaggccttcgggtcgtaaagctcggtagtgtgggaagaagagatgacggtaccacacgaaagccccggctaactacgtgccagcagccgcggtaagacgtagggggcgagcgttgtccggaattactgggcgtaaagggcgcgtaggcggtttagcaagtcaggtgtaaaaaacccgggctcaacctgggggatgcacttgaaactgctaagctagagggcaggagaggggagtggaattcccggtgtagcggtgaaatgcgtagatatcgggaggaataccagtggcgaaggcgactctctggactgaccctgacgctgaggcgcgaaagcgtggggagcaaacaggattagataccctggtagtccacgccgtaaacgatgggtactaggtgtgggatgcggaagcatttcgtgccgtagttaacgcaataagtaccccgcctggggagtacggccgcaaggttgaaactcaaaggaattgacgggggcccgcacaagcggtggagcatgtggtttaattcgaagcaacgcgaagaaccttaccagggcttgacatgcaggtagtagcgagccgaaaggtgagcgacccggcactcaagtgggcatgatagagaaggtagtaagagggggaatgaagtgcctacttgagtgccgggagcctgcacaggtggtgcatggttgtcgtcagctcgtgtcgtgagatgttgggttaagtcccgcaacgagcgcaacccttgcatctagttgccagtccgtcactcaactgaacatgttaggaaagagtagagagggagggatagcgtgttcagttgagtgacggaggcactctagatggactgccgtggacaacacggaggaaggcggggatgacgtcaaatcatcatgccctatatgccctgggccacacacgtgctacaatggccggtacagagggaggcgaagccgcgaggtggagcggaacccaaaaagccggtccaagttcggattgcaggctgcaactcgcctgcatgaaggcggaatcgctagtaatcgcggatcagcatgccgcggtgaatacgttcccgggccttgtacacaccgcccgtcacaccacgagagtctgcaacacccgaagccggtgacccaacccggcactcaagtgggcatgttaggaaaggtaggaagaggaagaatgatgtgtccacttgagtgccgggagggagccgtcgaaggtggggcagatgattggggtgaagtcgtaacaaggtagccgtatcggaaggtgcggctggatcacctcctttct

SEQ ID NO: 9717 - DNA, 1540 bp, Thermoanaerobacter thermocopriae
  ref <308>: DATABASE ACCESSION NUMBER: NCBI ACCESSION: NZ_BAZY01000070.1
  ref <309>: DATABASE ENTRY DATE: 2019-04-01
  ref <313>: RELEVANT RESIDUES IN SEQ ID NO: (1)..(1540)
ctgagagtttgatcctggctcaggacgaacgctggcggcgtgcctaacacatgcaagtcgagcggtccggcactcaacgtagttgggtggcggatagcggcggacgggtgagtaacgcgtgggcaacctacccttaagaccgggatagcacctcgaaaggggtggtaatactggataagctccttatagggcatcctatagggaggaaaggggagcgcaagctaccgcttaaggatgggcccgcgtcccatcagctagttggtagggtaacggcctaccaaggcgacgacgggtagccggcctgagagggtggacggccacactgggactgagacacggcccagactcctacgggaggcagcagtggggaatcttgggcaatgggcggaagcctgaccagcgacgccgcgtgggggaggaaggccttcgggttgtaaaccccgttagtgtgggaagaagggatgacggtaccacacgaaagccccggctaactacgtgccagcagccgcggtaagacgtagggggcgagcgttgtccggaattactgggcgtaaagggcgcgtaggcggtcaatcaagtcaggtgtaaaagacccgggctcaaccggggggtagcatctgaaactgattggctagagggcaggagaggggagtggaattcccggtgtagcggtgaaatgcgtagatatcgggaggaataccagtggcgaaggcgactctctggactggccctgacgctgaggcgcgaaagcgtggggagcgaacaggattagataccctggtagtccacgctgtaaacgatgggtactaggtgtggggcgcggaagcgttccgtgccgtagcgaacgcaataagtacccgcctggggagtacggccgcaaggttgaaactcaaaggaattgacgggggcccgcacaagcggtggagcatgtggtttaattcgaagcaacgcgaagaaccttaccagggcttgacatgcaggtagtagcgaaccgaaaggggagcgaccttaccgggaggtaaggagcctgcacaggtggtgcatggttgtcgtcagctcgtgtcgtgagatgttgggttaagtcccgcaacgagcgcaacccctgcctctagttgccagcgggtaagccgggcactctagggggactgccgtggaggacacggaggaaggtggggatgacgtcaaatcatcatgccctaaatgccctgggccacacacgtgctacaatggccggtacagagggaagcgaagccgtgaggcggagcgaatcccaaaaagccggtccaagttcggattgcaggctgcaactcgcctgcatgaagtcggaatcgctagtaatcgcggatcagcatgccgcggtgaatacgttcccgggccttgtacacaccgcccgtcacaccacgagagcctgcgacacccgaagccggtgacccaaccggggaggagggagccgtcgaaggtggggcaggtgattggggtgaagtcgtaacaaggtagccgtatcggaaggtgcggctggatcacctcctttctaaggaga

SEQ ID NO: 9718 - DNA, 310 bp, Thermoanaerobacter thermohydrosulfuricus
  ref <308>: DATABASE ACCESSION NUMBER: NCBI ACCESSION: NZ_FONI01000046.1
  ref <309>: DATABASE ENTRY DATE: 2019-04-01
  ref <313>: RELEVANT RESIDUES IN SEQ ID NO: (1)..(310)
aatgaagctgagagtttgatcctggctcaggacgaacgctggcggcgtgcctaacacatgcaagtcgagcggtccggcactcaactaagtgcttacttaaggggaaggaagtatagtagaagaagaaagtaataaaagtgaagcaaagtaaggtaagcacggagttgagtgccggatagcggcggacgggtgagtaacgcgtgggcaacctacccttaagaccgggataacacctcgaaaggggtgctaatactggataagctccttgtagggcatcctatggggagggaaggtagcggaagctaccgct

SEQ ID NO: 9719 - DNA, 531 bp, Thermoanaerobacter uzonensis
  ref <308>: DATABASE ACCESSION NUMBER: NCBI ACCESSION: NZ_FQUR01000003.1
  ref <309>: DATABASE ENTRY DATE: 2019-04-01
  ref <313>: RELEVANT RESIDUES IN SEQ ID NO: (1)..(531)
tctcttatgggagggagcctgcacaggtggtgcatggttgtcgtcagctcgtgtcgtgagatgttgggttaagtcccgcaacgagcgcaacccttgcatctagttgccagcgggtgaagccgggcactctagatggactgccgtggacaacacggaggaaggtggggatgacgtcaaatcatcatgccctatatgccctgggccacacacgtgctacaatggccggtacagagggaggcgaagccgcgaggtggagcggaacccaaaaagccggtccaagttcggattgcaggctgcaactcgcctgcatgaaggcggaatcgctagtaatcgcggatcagcatgccgcggtgaatacgttcccgggccttgtacacaccgcccgtcacaccacgagagtctgcaacacccgaagccggtgacccaaccgtaaggggggagccgtcgaaggtggggcagatgattggggtgaagtcgtaacaaggtagccgtatcggaaggtgcggctggatcacctcctttctaaggaga

SEQ ID NO: 9720 - DNA, 1608 bp, Thermoanaerobacter wiegelii
  ref <308>: DATABASE ACCESSION NUMBER: NCBI ACCESSION: NC_015958.1
  ref <309>: DATABASE ENTRY DATE: 2019-04-01
  ref <313>: RELEVANT RESIDUES IN SEQ ID NO: (1)..(1608)
tgagagtttgatcctggctcaggacgaacgctggcggcgtgcctaacacatgcaagtcgagcgattcagaggtcggaaatcgacttccgacttccgacctctggatagcggcggacgggtgagtaacgcgtgggcaacctacccttaagaccgggataacacctcgaaaggggtgctaatactggataagctccttgtagggcatcctatggggagggaaggtagcggaagctaccgcttaaggatgggcccgcgtcccatcagctagttggtagggtaacggcctaccaaggcgacgacgggtagccggcctgagagggtggtcggccacactgggactgagacacggcccagactcctacgggaggcagcagtggggaatcttgcgcaatgggcgaaagcctgacgcagcgacgccgcgtgagtgaagaaggccttcgggttgtaaagctcgatagtgtgggaagaatagatgacggtaccacacgaaagccccggctaactacgtgccagcagccgcggtaagacgtagggggcgagcgttgtccggaattactgggcgtaaagggcgcgtaggcggccacttaagtcaggtgtaaaaaacccgggctcaacccgggggatgcacatgaaactgggtggctagagggcaggagaggggagtggaattcccggtgtagcggtgaaatgcgtagatatcgggaggaataccagtggcgaaggcgactctctggactgaccctgacgctgaggcgcgaaagcgtggggagcaaacaggattagataccctggtagtccacgccgtaaacgatgggtactaggtgtgggatgcggaagcattccgtgccgtagttaacgcaataagtaccccgcctggggagtacggccgcaaggttgaaactcaaaggaattgacgggggcccgcacaagcggtggagcatgtggtttaattcgaagcaacgcgaagaaccttaccagggcttgacatgcaggtagtagcgagccgaaaggtgagcgagcctgccttatggtaggcagcctgcacaggtggtgcatggttgtcgtcagctcgtgtcgtgagatgttgggttaagtcccgcaacgagcgcaacccctgcttctagttgccatcggggaaagccgggcactctagagggactgccgtggacaacacggaggaaggtggggatgacgtcaaatcatcatgccctatatgctctgggccacacacgtgctacaatggccggtacagagggaagcgaagccgcgaggcggagcggaacccaaaaagccggtccaagttcggattgcaggctgcaactcgcctgcatgaagtcggaatcgctagtaatcgcggatcagcatgccgcggtgaatacgttcccgggccttgtacacaccgcccgtcacaccacgagagtctgcaacacccgaagccggtgacccaacccggcactcaagtggacatgggattatagggaagaaagaagatataatacgtgtccacttgagtgccgggggggagccgtcgaaggtggggcagatgattggggtgaagtcgtaacaaggtagccgtatcggaaggtgcggctggatcacctcctttct

SEQ ID NO: 9721 - DNA, 1586 bp, Thermoanaerobacteraceae bacterium SP2
  ref <308>: DATABASE ACCESSION NUMBER: NCBI ACCESSION: NZ_QSNL01000064.1
  ref <309>: DATABASE ENTRY DATE: 2019-04-01
  ref <313>: RELEVANT RESIDUES IN SEQ ID NO: (1)..(1586)
atgagagtttgatcctggctcaggacgaacgctggcggcgtgcctaacacatgcaagtcgagcggcgttgggaagtgagaagtgcgaagtaggaagtgggaatagaagaaattggcgaagccaatttcaacgaaacccacatcaaacttctcgcctctcacttcccgatgcagcggcggacgggtgagtaacacgtaggcaacctacccatcacacggggatagctcggggaaacccggggtaatacccgatacctttacttaccgcatggtaagtgaagaaagcgactaagcggtgatggatgggcctgcggcccattagctagttggcgggataacagcccaccaaggcaacgatgggtagccgacctgagagggtggccggccacactgggactgcgacacggcccagactcctacgggaggcagcagtgggggatattgcgcaatgggggaaaccctgacgcagcgacgccgcgtgagcgaagaaggccttcgggttgtaaagctcagtcatcggggacgaagaggacggtacccgaggaggaagccccggctaactacgtgccagcagccgcggtaatacgtagggggcgagcgttgtccggaattactgggtgtaaagggcgtgtaggcggtgatgcaagttatcggtaaaaacccggggctcaactccgggcttgccgataaaactgcatcacttgagtgcaggagagggaagtggaattcccggagtagcggtgaaatgcgtagataccgggaggaacaccagtggcgaaggcggcttcctggcctgtaactgacgctgaggcgcgaaagctgggggagcgaacgggattagataccccggtagtcccagccgtaaacgatggtcactaggtgtggggtgtggtcaagcactccgtgccggagctaacgcaataagtgacccacctggggagtacggccgcaaggttgaaactcaaaggaattgacgggggcccgcacaagcggtggagcatgtggtttaattcgaagcaacgcgaagaaccttaccaggccttgacatgcaggtagtagagaaccgaaaggggatcgacccaagggaaaccgagggagcctgcacaggtggtgcatggttgtcgtcagctcgtgtcgtgagatgttgggttaagtcccgcaacgagcgcaacccctatacttagttgccagcacggaaggtgggcactctaagtagactgccgcagacaatgcggaggaaggtggggatgacgtcaaatcatcatgccctttatggcctgggccacacacgtgctacaatggcctgaacagcgggaagcgaaggagcgatcctgagcaaacccctgaaaacaggtcccagttcagattgcaggctgcaactcgcctgcatgaaggcggaatcgctagtaatcgcggatcagcatgccgcggtgaatacgttcccgggccttgtacacaccgcccgtcacaccacgaaagttggcaacacccgaagccgggaaaaccgtctaaggtggggtcagcgattggggtgaagtcgtaacaaggtagccgtatcggaaggtgcggctggatcacctcctttct

SEQ ID NO: 9722 - DNA, 1586 bp, Thermoanaerobacterales bacterium SK-G1; identical to SEQ ID NO: 9721
  ref <308>: DATABASE ACCESSION NUMBER: NCBI ACCESSION: NZ_CP033169.1
  ref <309>: DATABASE ENTRY DATE: 2019-04-01
  ref <313>: RELEVANT RESIDUES IN SEQ ID NO: (1)..(1586)

SEQ ID NO: 9723 - DNA, 275 bp, Thermoanaerobacterium aotearoense
  ref <308>: DATABASE ACCESSION NUMBER: NCBI ACCESSION: NZ_AYSN01000072.1
  ref <309>: DATABASE ENTRY DATE: 2019-04-01
  ref <313>: RELEVANT RESIDUES IN SEQ ID NO: (1)..(275)
aaacatgagagtttgatcctggctcaggacgaacgctggcggcgtgcctaacacatgcaagtcgagcgaagggagtactacggtacgaacttagcggcggacgggtgagtaacgcgtggacaatctaccctgtagaccgggataacaccccgaaaggggtgctaataccggataatgtcaataagtggcatcacttgttgaagaaaggagaaatccgctataggatgagtccgcgtcccattagctagttggcggggtaaaagcccaccaaggcg

SEQ ID NO: 9724 - DNA, 1577 bp, Thermoanaerobacterium saccharolyticum
  ref <308>: DATABASE ACCESSION NUMBER: NCBI ACCESSION: NZ_BBKT01000015.1
  ref <309>: DATABASE ENTRY DATE: 2019-04-01
  ref <313>: RELEVANT RESIDUES IN SEQ ID NO: (1)..(1577)
tgagagtttgatcctggctcaggacgaacgctggcggcgtgcctaacacatgcaagtcgagcgaagggagtactacggtacgaacttagcggcggacgggtgagtaacgcgtggacaatctaccctgtagactgggataacactgcgaaagtggtgctaataccggataatgtcgagaagcggcatcgcttttcgaagaaaggagggaatccgctataggaggagtccgcgtcccattagctagttggcggggtaaaagcccaccaaggcgacgatgggtagccggcctgagagggtgaacggccacactggaactgagacacggtccagactcctacgggaggcagcagtggggaatattgtgcaatgggggaaaccctgacacagcgacgccgcgtgagcgaagaaggccttcgggtcgtaaagctcaatagtatgggaagataatgacggtaccatacgaaagccccggctaactacgtgccagcagccgcggtaatacgtagggggcgagcgttgtccggaattactgggcgtaaagagcacgtaggcggctgtaaaagtcagatgtgaaaaacctgggctcaaccgagggtgtgcatctgaaactatatagcttgagtcaaggagaggagagtggaattcctggtgtagcggtgaaatgcgtagagatcaggaagaataccagtggcgaaagcggctctctggacttgaactgacgctgaggtgcgaaagcgtggggagcaaacaggattagataccctggtagtccacgccgtaaacgatggatactaggtgtgggttagtataatccgtgccggagttaacgcaataagtatcccgcctggggagtacggccgcaaggttgaaactcaaaggaattgacgggggcccgcacaagcagcggagcatgtggtttaattcgaagcaacgcgaagaaccttaccagggcttgacatccacagaatctggtagaaataccggagtgcctcgaaagaggagctgtgagacaggtggtgcatggttgtcgtcagctcgtgtcgtgagatgttgggttaagtcccgcaacgagcgcaacccctgttggtagttaccagcgagaaagacggggactctaccgagactgccgtggataacacggaggaaggcggggatgacgtcaaatcatcatgccctttatgccctgggctacacacgtgctacaatggcctgaacagagggcagcgaaggagcgatccggagcgaatcccagaaaacaggtcccagttcagattgcaggctgcaacccgcctgcatgaagacggagttgctagtaatcgcggatcagcatgccgcggtgaatacgttcccgggccttgtacacaccgcccgtcacaccacgagagtttacaacacccgaagtcagtgacctaacccggcactcaagtggatatggaattatagagaagaaaagaaaaaatccgtatctacttgagtgccgggaaggagctgccgaaggtggggtaaatgattggggtgaagtcgtaacaaggtagccgtatcggaaggtgcggctggatcacctcctttctaaggag

SEQ ID NO: 9725 - DNA, 1515 bp, Thermoanaerobacterium sp. PSU-2
  ref <308>: DATABASE ACCESSION NUMBER: NCBI ACCESSION: NZ_MSQD01000035.1
  ref <309>: DATABASE ENTRY DATE: 2019-04-01
  ref <313>: RELEVANT RESIDUES IN SEQ ID NO: (1)..(1515)
tgagagtttgatcctggctcaggacgaacgctggcggcgtgcctaacacatgcaagtcgagcgaagggagtactacggtacgaacttagcggcggacgggtgagtaacgcgtggacaatctaccctgtagaccgggataacacctcgaaaggggtgctaataccggataatgtcaaatgatggcatcatcatttgaagaaaggagaaatccgctataggatgagtccgcgtcccattagctagttggcggggtaaaagcccaccaaggcgacgatgggtagccggcctgagagggtgaacggccacactggaactgagacacggtccagactcctacgggaggcagcagtggggaatattgtgcaatgggggaaaccctgacacagcgacgccgcgtgagcgaagaaggccttcgggtcgtaaagctcaatagtatgggaagataatgacggtaccatacgaaagccccggctaactacgtgccagcagccgcggtaatacgtagggggcgagcgttgtccggaattactgggcgtaaagagcacgtaggcggctataaaagtcagatgtgaaaaacctgggctcaaccgagggtatgcatctgaaactaaatagcttgagtcaaggagaggagagcggaattcctggtgtagcggtgaaatgcgtagagatcaggaagaataccagtggcgaaagcggctctctggacttgaactgacgctgaggtgcgaaagcgtggggagcaaacaggattagataccctggtagtccacgccgtaaacgatggatactaggtgtgggtgaggaatcatccgtgccggagttaacgcaataagtatcccgcctggggagtacggccgcaaggttgaaactcaaaggaattgacgggggcccgcacaagcagcggagcatgtggtttaattcgaagcaacgcgaagaaccttaccagggcttgacatccacagaatctggtagaaataccggagtgcctcgcaagaggagctgtgagacaggtggtgcatggttgtcgtcagctcgtgtcgtgagatgttgggttaagtcccgcaacgagcgcaacccctgttggtagttaccagcgtaaagacggggactctaccgagactgccgtggaaaacacggaggaaggcggggatgacgtcaaatcatcatgccctttatgccctgggctacacacgtgctacaatggcctgaacagagggcagcgaaggagcgatccggagcgaatcccagaaaacaggtcccagttcagattgcaggctgcaacccgcctgcatgaagacggagttgctagtaatcgcggatcagcatgccgcggtgaatacgttcccgggccttgtacacaccgcccgtcacaccacgagagtttacaacacccgaagtcagtgacctaaccgcaagggaggagctgccgaaggtggggtaaatgattggggtgaagtcgtaacaaggtagccgtatcggaaggtgcggctggatcacctcctttctaaggag

SEQ ID NO: 9726 - DNA, 1522 bp, Thermoanaerobacterium sp. RBIITD
  ref <308>: DATABASE ACCESSION NUMBER: NCBI ACCESSION: NZ_LT906662.1
  ref <309>: DATABASE ENTRY DATE: 2019-04-01
  ref <313>: RELEVANT RESIDUES IN SEQ ID NO: (1)..(1522)
tttaaacatgagagtttgatcctggctcaggacgaacgctggcggcgtgcctaacacatgcaagtcgagcggagtaaatactatacggtatttacttagcggcggacgggtgagtaacacgtggacaatctaccctatagaccgggataacacaccgaaaggggtgctaataccggataatgtcacgaggtggcatcatcttgtgaagaaaggagaaatccgctaaaggaagagtccgcggcccattagctagttggtgaggtaaaggcccaccaaggcaacgatgggtagccggcctgagagggtgaacggccacactggaactgagagacggtccagactcctacgggaggcagcagtggggaatattgcgcaatggggggaaccctgacgcagcaacgccgcgtgagcgaagaaggccttcgggtcgtaaagctcaatagtatgggaagaaagaaatgacggtaccatacgaaagccccggctaactacgtgccagcagccgcggtaatacgtagggggcgagcgttgtccggaattactgggcgtaaagagcacgtaggcggctatataagtcagatgtaaaaaacctgggcttaaccgaggggatgcaactgaaactatatagcttgagtcaaggagaggagagcggaattcctggtgtagcggtgaaatgcgtagagatcaggaagaataccagtggcgaaagcggctctctggacttgaactgacgctgaggtgcgaaagcgtggggagcaaacaggattagataccctggtagtccacgccgtaaacgatggatactaggtgtgggtgaggaatcatccgtgccggagttaacgcaataagtatcccgcctggggagtacggccgcaaggctgaaactcaaaggaattgacgggggcccgcacaagcagcggagcatgtggtttaattcgaagcaacgcgaagaaccttaccagggcttgacatccacagaatcgagtagaaatactcgagtgcctcgtaagaggagctgtgagacaggtggtgcatggttgtcgtcagctcgtgtcgtgagatgttgggttaagtcccgcaacgagcgcaacccctgttggtagttgccagcgtaaagacgggcactctaccgagactgccgtggacaacacggaggaaggtggggatgacgtcaaatcatcatgccctttatgccctgggctacacacgtgctacaatggcctgaacaaaggggagcgaaggagcgatccggagcgaatcccaaaaaacaggtcccagttcagattgcaggctgcaacccgcctgcatgaagacggagttgctagtaatcgcagatcagcatgctgcggtgaatacgttcccgggccttgtacacaccgcccgtcacaccacgagagtttacaacacccgaagtcagtgagctaaccgaaaggaggcagctgccgaaggtggggtaaatgattggggtgaagtcgtaacaaggtagccgtatcggaaggtgcggctggatcacctcctttct

SEQ ID NO: 9727 - DNA, 1523 bp, Thermoanaerobacterium thermosaccharolyticum
  ref <308>: DATABASE ACCESSION NUMBER: NCBI ACCESSION: NZ_MINB01000058.1
  ref <309>: DATABASE ENTRY DATE: 2019-04-01
  ref <313>: RELEVANT RESIDUES IN SEQ ID NO: (1)..(1523)
aacatgagagtttgatcctggctcaggacgaacgctggcggcgtgcctaacacatgcaagtcgagcgaagggagtactacggtacgaacttagcggcggacgggtgagtaacgcgtggacaatctaccctgtagactgggataacacctcgaaaggggtgctaataccggataatgtcgagaagcggcatcgcttttcgaagaaaggagagaatccgctataggaggagtccgcgtcccattagctagttggtgagggtaacggcccaccaaggcgacgatgggtagccggcctgagagggtgaacggccacactggaactgagacacggtccagactcctacgggaggcagcagtggggaatattgtgcaatgggggaaaccctgacacagcgacgccgcgtgagtgaagaaggccttcgggtcgtaaagctcaatagtatgggaagaaagaaatgacggtaccatacgaaagccccggctaactacgtgccagcagccgcggtaatacgtagggggcgagcgttgtccggaattactgggcgtaaagagcacgtaggcggctataaaagtcagatgtgaaaaacctgggctcaaccgagggtatgcatctgaaactaaatagcttgagtcaaggagaggagagcggaattcctggtgtagcggtgaaatgcgtagagatcaggaagaataccagtggcgaaagcggctctctggacttgaactgacgctgaggtgcgaaagcgtggggagcaaacaggattagataccctggtagtccacgccgtaaacgatggatactaggtgtgggttagtataatccgtgccggagttaacgcaataagtatcccgcctggggagtacggccgcaaggttgaaactcaaaggaattgacgggggcccgcacaagcagcggagcatgtggtttaattcgaagcaacgcgaagaaccttaccagggcttgacatccacagaatcgagtagaaatacttgagtgcctcgtaagaggagctgtgagacaggtggtgcatggttgtcgtcagctcgtgtcgtgagatgttgggttaagtcccgcaacgagcgcaacccctgttggtagttaccagcgtaaagacggggactctaccgagactgccgtggataacacggaggaaggcggggatgacgtcaaatcatcatgccctttatgccctgggctacacacgtgctacaatggcctgaacagagggcagcgaaggagcgatccggagcgaatcccagaaaacaggtcccagttcagattgcaggctgcaacccgcctgcatgaagacggagttgctagtaatcgcggatcagcatgccgcggtgaatacgttcccgggccttgtacacaccgcccgtcacaccacgagagtttacaacacccgaagtcagtgacctaaccgaaagggaggagctgccgaaggtggggtaaatgattggggtgaagtcgtaacaaggtagccgtatcggaaggtgcggctggatcacctcctttctaaggag

SEQ ID NO: 9728 - DNA, 1592 bp, Thermoanaerobacterium xylanolyticum
  ref <308>: DATABASE ACCESSION NUMBER: NCBI ACCESSION: NC_015555.1
  ref <309>: DATABASE ENTRY DATE: 2019-04-01
  ref <313>: RELEVANT RESIDUES IN SEQ ID NO: (1)..(1592)
atgagagtttgatcctggctcaggacgaacgctggcggcgtgcctaacacatgcaagtcgagcgatccggcactcaactaagcgcttacagaaaaaaagacagcaaagagaaaagaaagcagaaaaagagagaaataagagtaaacgcggagttgagtgccggatagcggcggacgggtgagtaacgcgtggacaatctaccctgtagactgggataacaccccgaaaggggtgctaataccggataatgtcaagtaatggcatcattgcttgaagaaaggagaaatccgctataggatgagtccgcgtcccattagctagttggcggggtaaaagcccaccaaggcgacgatgggtagccggcctgagagggtgaacggccacactggaactgagacacggtccagactcctacgggaggcagcagtggggaatattgtgcaatgggggaaaccctgacacagcgacgccgcgtgagcgaagaaggccttcgggtcgtaaagctcaatagtatgggaagataatgacggtaccatacgaaagccccggctaactacgtgccagcagccgcggtaatacgtagggggcgagcgttgtccggaattactgggcgtaaagagcacgtaggcggctataaaagtcagatgtgaaaaacctgggctcaaccgagggtatgcatctgaaactaaatagcttgagtcaaggagaggagagcggaattcctggtgtagcggtgaaatgcgtagagatcaggaagaataccagtggcgaaagcggctctctggacttgaactgacgctgaggtgcgaaagcgtggggagcaaacaggattagataccctggtagtccacgccgtaaacgatggatactaggtgtgggttagtataatccgtgccggagttaacgcaataagtatcccgcctggggagtacggccgcaaggttgaaactcaaaggaattgacgggggcccgcacaagcagcggagcatgtggtttaattcgaagcaacgcgaagaaccttaccagggcttgacatccacagaatccggtagaaataccggagtgcctcgaaagaggagctgtgagacaggtggtgcatggttgtcgtcagctcgtgtcgtgagatgttgggttaagtcccgcaacgagcgcaacccctgttggtagttaccagcgtaaagacggggactctaccgagactgccgtggataacacggaggaaggcggggatgacgtcaaatcatcatgccctttatgccctgggctacacacgtgctacaatggcctgaacagagggcagcgaaggagcgatccggagcgaatcccagaaaacaggtcccagttcagattgcaggctgcaacccgcctgcatgaagacggagttgctagtaatcgcggatcagcatgccgcggtgaatacgttcccgggccttgtacacaccgcccgtcacaccacgagagtttacaacacccgaagtcagtgacctaaccgcaaggaaggagctgccgaaggtggggtaaatgattggggtgaagtcgtaacaaggtagccgtatcggaaggtgcggctggatcacctcctttctaaggag

SEQ ID NO: 9729 - DNA, 1509 bp, Thermobaculum terrenum
  ref <308>: DATABASE ACCESSION NUMBER: NCBI ACCESSION: NC_013525.1
  ref <309>: DATABASE ENTRY DATE: 2019-04-01
  ref <313>: RELEVANT RESIDUES IN SEQ ID NO: (1)..(1509)
atggagagtttgatcctggctcaggatgaacgctggcggcgtgcctaacgcatgcaagtcgtgcgggtagaccttcgggtctgccagcggcgaacgggtgagtaacacgtgggtaacctgccgtctggtgggggataaccctcagaaatgggggctaataccgcatgatgatcctcgctcgatggagtggggattgaaagccgcaaggcgccaggcgaggggcccgcggcccatcagctagttggtggggtaatggcccaccaaggctatgacgggtagctggtctgagaggacggccagccacactgggactgagacacggcccagactcctacgggaggcagcagcgaggaatcttccccaatggcccatctggggctgagggagcgacgccgcgtggaggaagaagcccttcggggtgtaaactccttttgggtgggaagatgatgacggtaccacccgaataagtcccggctaactacgtgccagcagccgcggtaacacgtagggggcgagcgttatccggattcactgggcgtaaagagcgcgtaggcggttccgcaagtcacccgtgaaagcccccggctcaaccggggagggccgggtgatactgtggggcttgagggcggaagagggaagcggaattcccggtgtagcggtgaaatgcgtagataccgggaggaacaccagtggcgaaggcggcttcctggtccgtacctgacgctgaggcgcgaaggctaggggagcgaacgggattagataccccggtagtcctagcagtaaacgatggacgctcggtgtcggcggtatccactccgtcggtgcccaagctaacgcattaagcgtcccgcctggggagtacggccgcaaggctaaaactcaaaggaattgacgggggcccgcacaagcagcggagcgtgtggtttaattcgatgcaacgcgaagaaccttaccagggcttgacatgcaggtgaaagcctggggaaactcaggcccccacttcggtggcacctgcacaggtgttgcatggctgtcgtcagctcgtgccgtgaggtgttgggttaagtcccgcaacgagcgcaaccctcgtcgcaagttaccctctcttgcgagactgccgggtgcaacccggaggaaggtggggatgacgtcaagtcagcatgacccttatgccctgggctacacacacgctacaatggccggtacagagggtggccaacccgcgagggggagctaatcccacaaagccggtctcagttggaattagaggctgaaacccgcctctatgaacgcggagttgctagtaaccgcaggtcagcactactgcggtgaatatgttcccgggccttgtacacaccgcccgtcacgtcacgaaagccggcaacacctgaagccggtgggccaacccgcaagggaggcagccgtctagggtggggctggtgattgggacgaagtcgtaacaaggtagccgtaccggaaggtgcggctggatcacctcctttctaggga

SEQ ID NO: 9730 - DNA, 1537 bp, Thermobifida halotolerans
  ref <308>: DATABASE ACCESSION NUMBER: NCBI ACCESSION: NZ_JRUV01000259.1
  ref <309>: DATABASE ENTRY DATE: 2019-04-01
  ref <313>: RELEVANT RESIDUES IN SEQ ID NO: (1)..(1537)
ttgatggagagtttgatcctggctcaggacgaacgctggcggcgtgcttaacacatgcaagtcgagcggtaaggccccttcgggggtacacgagcggcgaacgggtgagtaacacgtgagtaacctgcccctgactctgggataagcccgggaaaccgggtctaataccggatatgactcctgcctgcatgggtgggggtggaaagttgtttcggttggggatgggctcgcggcctatcagcttgttggtggggtgatggcctaccaaggcgatgacgggtagccggcctgagagggcgaccggccacactgggactgagacacggcccagactcctgcgggaggcagcagtggggaatattgcgcaatgggcggaagcctgacgcagcgacgccgcgtgggggatgacggccttcgggttgtaaacctcttttaccactgacgtaggcttccagtgttctgggggttgacggtaggtggggaataaggaccggctaactacgtgccagcagccgcggtaatacgtagggtccgagcgttgtccggaattattgggcgtaaagagctcgtaggcggcttgtcgcgtctgctgtgaaagcccggggcttaacttcgggtgtgcagtggatacgggcaggcttgaggtaggtaggggagactggaattcctggtgtagcggtgaaatgcgcagatatcaggaggaacaccggtggcgaaggcgggtctctgggccttacctgacgctgaggagcgaaagcgtggggagcgaacaggattagataccctggtagtccacgctgtaaacgttgggcgctaggtgtggggactttccacggtttccgtgccgtagctaacgcattaagcgccccgcctggggagtacggccgcaaggctaaaactcaaaggaattgacgggggcccgcacaagcggcggagcatgttgcttaattcgacgcaacgcgaagaaccttaccaaggtttgacatcaccggtaatcctgcagagatgtggggtccttcggggatcggtgacaggtggtgcatggctgtcgtcagctcgtgtcgtgagatgttgggttaagtcccgcaacgagcgcaacccttgttccatgttgccagcacgtgatggtggggactcatgggagactgccggggtcaactcggaggaaggtggggatgacgtcaagtcatcatgccccttatgtcttgggctgcaaacatgctacaatggccggtacagagggcgtgcgatgtcgtgaggcggagcgaatctcttaaagccggtctcagttcggattggggtctgcaactcgaccccatgaaggtggagtcgctagtaatcgcggatcagcaacgccgcggtgaatacgttcccgggccttgtacacaccgcccgtcacgtcacgaaagtcggcaacacccgaaacgcgtggcctaacccttcggggagggagcgtgtgaaggtggggctggtgattgggacgaagtcgtaacaaggtagccgtaccggaaggtgcggctggatcacctcctttcta

SEQ ID NO: 9731 - DNA, 1543 bp, Thermoclostridium stercorarium
  ref <308>: DATABASE ACCESSION NUMBER: NCBI ACCESSION: NZ_CP014673.1
  ref <309>: DATABASE ENTRY DATE: 2019-04-01
  ref <313>: RELEVANT RESIDUES IN SEQ ID NO: (1)..(1543)
tttaatttgagggtttgatcctggctcaggacgaacgctggcggcgtgcctaacacatgcaagtcgaacgggatccgtgttacggaggtctttggaccgaagtggcatggtgagagtggcggacgggcgagtaacgcgtgagcaacctgccctatgctgggggataacaccgggaaaccggtgctaataccgcataagaccacagtgacgcatgtcacagtggtaaaagctgaggcggcataggatgggctcgcgtccgattagctagttggtagggtaacggcctaccaaggcgacgatcggtagccggactgagaggttggccggccgcattgggactgagacacggcccagactcctacgggaggcagcagtggggaatattgcgcaatgggggaaaccctgacgcagcgacgccgcgtggaggaagaaggcctttgggttgtaaactcctttgatcggggacgaagatgacggtacccgaagaacaagccacggctaactacgtgccagcagccgcggtaatacgtaggtggcgagcgttgtccggaattactgggtgtaaagggcgtgtaggcggggtgccaagtcaggtgtgaaataccggggcttaacctcgggggtgcatctgaaactggtgctcttgagtgccggagaggaaagcggaattcccagtgtagcggtgaaatgcgtagatattgggaggaacaccagtggcgaaggcggctttctggacggtaactgacgctgaggcgcgaaagcgtggggagcaaacaggattagataccctggtagtccacgctgtaaacgatggatactaggtgtaggaggtatcgaccccttctgtgccgtagttaacacaataagtatcccacctggggagtacggccgcaaggctgaaactcaaaggaattgacgggggcccgcacaagcagtggagcatgtggtttaattcgaagcaacgcgaagaaccttaccagggcttgacatccccctgacggatgtagagatacatcttctccgcaaggagcaggggagacaggtggtgcatggttgtcgtcagctcgtgtcgtgagatgttgggttaagtcccgcaacgagcgcaacccttgtcgttagttgccagcagtaagatgggcactctaacgagactgccggcgagaagtcggaggaaggtggggatgacgtcaaatcatcatgccccttatgtcctgggctacacacgtgctacaatggcgactacagagggaagcaaatccgcgaggaggagcaaatcccgaaaggtcgtcccagttcggattgcaggctgcaactcgcctgcatgaagccggaattgctagtaatggcaggtcagcatactgccgtgaatacgttcccgggccttgtacacaccgcccgtcacaccatgagagctggcaacacccgaagccggtagcctaaccgagaggggggcgccgtcgaaggtggggtcagtgattggggtgaagtcgtaacaaggtagccgtatcggaaggtgcggctggatcacctcctttctaaggag

SEQ ID NO: 9732 - DNA, 1586 bp, Thermocrinis albus
  ref <308>: DATABASE ACCESSION NUMBER: NCBI ACCESSION: NC_013894.1
  ref <309>: DATABASE ENTRY DATE: 2019-04-01
  ref <313>: RELEVANT RESIDUES IN SEQ ID NO: (1)..(1586)
ttccttgaagagtttgatcctggctcagcgcgaacgctggcggcgtgcctaacacatgcaagtcgtgcgcaggctcatctgtcctctggacagatgggtgctgagcggcaaacgggtgagtaacacgtgcctaacctacccccaggaaggggataaccctccgaaaggggggctaataccctataaagccgggggccactaaggctacccggccaaagggggcctctggtctctgaccatgctcccgcctggggatgggggcgcggcccatcaggtagttggtggggtaacggcctaccaagcctatgacgggtagccggcctgagagggtggccggccacagtgggactgagacacggcccacacccctacggggggcagcagtggggaatcgtgggcaatgggcgaaagcctgaccccgcgacgccgcgtgggggatgaagcccttcggggtgtaaacccctgtcgggggggacgatgcggcctggggcgaacagtctcgggtcgtgacggtacccccagaggaagggacggctaactacgtgccagcagccgcggtaatacgtaggtcccgagcgttgcgcgaattcactgggcgtaaagcgtccgcagccggacgggtaagcggttcgtcaaagcccacggctcaaccgtggaacggcgtaccgaactgcccgtcttgaggcacgctcaggcaggcggaattcccggtgtagcggtgaaatgcgtagatatcgggaggaacaccgaaggcgaaggcagcctgctggggctgtcctgacggtcagggacgaaagctgggggagcgaaccggattagatacccgggtagtcccagccgtaaaccatgggcgcttggcgtcgtccgtaagggcggtgccgcagctaacgcggtaagcgccccgcctggggagtacgggcgcaagcctgaaactcaaaggaattggcgggggcccgcacaaccggtggagcgtctggttcaattcgatgctaaccgaaaaaccttacccgggcttgacatggtgggaaacccctgcgaaagcggggggtgccgtcctctggacggaatcccaccacaggtggtgcatggccgtcgtcagctcgtgtcgtgagatgttgggttaagtcccgcaacgagcgcaacccctgcccttagttgctaccccgtaaggggagcactctaaggggaccgccggcgataagccggaggaaggtggggatgacgtcaggtcagtatgccctttatgcccggggctacacaggcgctacagtggccgggacaatgggatgcgacccagtaatggggagctaatcccccaaacccggtcatggtgcagattgagggctgaaactcgccctcatgaagccggaatcggtagtaatggcggatcagctaagccgccgtgaatacgttctcgggccttgcacacaccgcccgtcacgccacggaagtcagtcttcccggaagcccccgggctaaccggtcttcggaccggaggcaggggacgatgggaaggctggcaactggggcgaagtcgtaacaaggtagccgtaggggaacctgcggctggatcacctcctttttaa

SEQ ID NO: 9733 - DNA, 1574 bp, Thermocrinis minervae
  ref <308>: DATABASE ACCESSION NUMBER: NCBI ACCESSION: NZ_LT670846.1
  ref <309>: DATABASE ENTRY DATE: 2019-04-01
  ref <313>: RELEVANT RESIDUES IN SEQ ID NO: (1)..(1574)
ttttattgaagagtttgatcctggctcagcgcgaacgctggcggcgtgcctaacacatgcaagtcgtgcgcaggctcgcccttcggggcgggtgctgagcggcaaacgggtgagtaacacgtgagtaacctgccctcgggaaggggataaccctccgaaaggggggctaataccctataatgccctgggtcactaaggctcagggtgaaaggtggcctctgctctgcatgctaccgcccgaggaggggctcgcggcccatcaggtagttggtggggtaacggcctaccaagcctatgacgggtagccggcctgagagggtggccggccacagtgggactgagacacggcccacacccctacggggggcagcagtggggaatcgtgggcaatgggcgaaagcctgaccccgcgacgccgcgtgggggaagaagcccttcggggtgtaaacccctgtcgggggggacgatgcggccatggacgaatagtccttggtcgtgacggtacccccagaggaagggacggctaactacgtgccagcagccgcggtaatacgtaggtcccgagcgttgcgcgaattcactgggcgtaaagcgtccgcagccggatgggtaagcggtttgtcaaagcccaccgctcaacggtggaaaggcaaaccgaactgcccatcttgaggcaagctcaggtaggcggaattcccggtgtagcggtgaaatgcgtagatatcgggaggaacaccggtggcgaaggcggcctactggagctgtcctgacggtcagggacgaaagctgggggagcaaaccggattagatacccgggtagtcccagccgtaaaccatgggtgctaggcgttgtccctttggggcagtgccggagctaacgcgttaagcgccccgcctggggagtacgggcgcaagcctgaaactcaaaggaattggcgggggcccgcacaaccggtggagcgtctggttcaattcgatgctaaccgaaaaaccttacccgggcttgacatggtgggaaacccttgcgaaagcgaggggtgccgtcctctggacggaatcccaccacaggtggtgcatggccgtcgtcagctcgtgtcgtgagatgttgggttaagtcccgcaacgagcgcaacccctgcccttagttgctacgccggaaggcgggcactctaaggggactgccggcgataagccggaggaaggtggggatgacgtcaggtcagtatgccctttatgcccggggctacacaggcgctacagtggccaggacaatgggaagcgacccagtaatggggagcaaatccctaaacctggtcatggtgcagattgagggctgaaactcgccctcatgaagccggaatcggtagtaatggcggatcagctaagccgccgtgaatacgttctcgggccttgcacacaccgcccgtcacgccacggaagtcagtcttcccggaagccctcgggctaaccacctgcaagggtgggggcagaggacgatgggaaggctggcaactggggcgaagtcgtaacaaggtagccgtaggggaacctgcggctggatcacctcctttaaa

SEQ ID NO: 9734 - DNA, 1566 bp, Thermocrinis ruber
  ref <308>: DATABASE ACCESSION NUMBER: NCBI ACCESSION: NZ_CP007028.1
  ref <309>: DATABASE ENTRY DATE: 2019-04-01
  ref <313>: RELEVANT RESIDUES IN SEQ ID NO: (1)..(1566)
ttttcctgaagagtttgatcctggctcagcgcgaacgctggcggcgtgcctaacacatgcaagtcgtgcggaggggtgatgagcccctcagcggcaaacgggtgagtaacacgtgagtaacctgcccctgggaaggggataaccctccgaaaggggggctaataccctatatagccggggaccactaaggtctcccggtgaaaggtggcctctgcccttcacgggcatgctaccgcccagggaggggctcgcggcccatcaggtagttggtggggtaacggcctaccaagcctatgacgggtagccggcctgagagggtggccggccacagtgggactgagacacggcccacacccctacggggggcagcagtggggaatcgtgggcaatgggcgaaagcctgaccccgcgacgccgcgtgggggatgaagcccttcggggtgtaaacccctgtcgggggggacgatgtgtcctggggtgaataatcccagggcatgacggtacccccagaggaagggacggctaactacgtgccagcagccgcggtaatacgtaggtcccgagcgttgcgcgaattcactgggcgtaaagcgtccgcagccggacgggtaagcggtgcgtcaaagcccaccgctcaacggtggaacggcgtaccgaactgcctgtcttgaggcacgctcaggcaggcggaattcccggtgtagcggtgaaatgcgtagatatcgggaggaacaccgaaggcgaaggcagcctgctggagctgtcctgacggtcagggacgaaagctgggggagcaaaccggattagatacccgggtagtcccagccgtaaaccatgggcgcttggcgtcgtcctcgtggcggtgccgcagctaacgcggtaagcgccccgcctggggagtacgggcgcaagcctgaaactcaaaggaattggcgggggcccgcacaaccggtggagcgtctggttcaattcgatgctaaccgaaaaaccttacccgggcttgacatggtgggaaacccttgcgaaagcgaggggtgccgtcctctggacggaatcccaccacaggtggtgcatggccgtcgtcagctcgtgtcgtgagatgttgggttaagtcccgcaacgagcgcaacccctgcccttagttgctaccccgaatggggagcactctaaggggactgccggcgataagccggaggaaggtggggatgacgtcaggtcagtatgccctttatgcccggggcaacacaggcgctacagtggccaggacaatgggatgcgacccagtaatggggagcaaatcccccaaacctggtcatggtgcagattgagggctgaaactcgccctcatgaagccggaatcggtagtaatggcggatcagctaagccgccgtgaatacgttctcgggccttgcacacaccgcccgtcacgccacggaagtcagtcttcccggaaggccccgagctaacccgcaagggaggcaggggacgatgggaaggctggcaactggggcgaagtcgtaacaaggtagccgtaggggaacctgcggctggatcacctccttttta

SEQ ID NO: 9735 - DNA, 1564 bp, Thermocrinis sp. GBS
  ref <308>: DATABASE ACCESSION NUMBER: NCBI ACCESSION: NZ_JNIE01000002.1
  ref <309>: DATABASE ENTRY DATE: 2019-04-01
  ref <313>: RELEVANT RESIDUES IN SEQ ID NO: (1)..(1564)
tttttatgaagagtttgatcctggctcagcgcgaacgctggcggcgtgcctaacacatgcaagtcgtgcggaggggtgatgagcccctcagcggcaaacgggtgagtaacacgtgagtaacccacccttgggaaggggataaccttccgaaaggaaggctaataccctatattgccgggggtcactaagacttcccggtgaaaggtggcctctgcccgcaagggcatgctaccgcccaaggaggggctcgcggcccatcaggtagttggtggggtaacggcctaccaagcctacgacgggtagccggcctgagagggtggtcggccacagtgggactgagacacggcccacacccctacggggggcagcagtggggaatcgtgggcaatgggcgaaagcctgaccccgcgacgccgcgtggaggaagaagcccttcggggtgtaaactcctgtcgggggggacgatgtggctcggggtgaataatctcgggccatgacggtacccccagaggaagggacggctaactacgtgccagcagccgcggtaatacgtaggtcccgagcgttgcgcgaattcactgggcgtaaagcgtccgcagccggatgggtaagcgtttcgtcaaagcccaccgctcaacggtggaacggcgaaacgaactgcccatcttgaggcacgctcaggcaggcggaattcccggtgtagcggtgaaatgcgtagatatcgggaggaacaccgaaggcgaaggcagcctgctggagctgtcctgacggtcagggacgaaagctgggggagcaaaccggattagatacccgggtagtcccagccgtaaaccatgggcgcttggcgtcgtccttgtggcggtgccgcagctaacgcggtaagcgccccgcctggggagtacgggcgcaagcctgaaactcaaaggaattggcgggggcccgcacaaccggtggagcgtctggttcaattcgatgctaaccgaaaaaccttacccgggcttgacatggtgggaaacccttgcgaaagcgaggggtgctgtcctctggacagaatcccaccacaggtggtgcatggccgtcgtcagctcgtgtcgtgagatgttgggttaagtcccgcaacgagcgcaacccctgcccttagttgctaccccggaaggggagcactctaaggggactgccggcgataagccggaggaaggtggggatgacgtcaggtcagtatgccctttatgcccggggcaacacaggcgctacagtggccgggacaatgggatgcgacccagtaatggggagccaatcctcaaacccggtcatggtgcagattgagggctgaaactcgccctcatgaagccggaatcggtagtaatggcggatcagctaagccgccgtgaatacgttctcgggccttgcacacaccgcccgtcacgccacggaagtcagtcttcccggaagcccccgagctaacccgaaagggaggcaggggacgatgggaaggctggcaactggggcgaagtcgtaacaaggtagccgtaggggaacctgcggctggatcacctccttttta

SEQ ID NO: 9736 - DNA, 1470 bp, Thermodesulfatator atlanticus
  ref <308>: DATABASE ACCESSION NUMBER: NCBI ACCESSION: NZ_ATXH01000052.1
  ref <309>: DATABASE ENTRY DATE: 2019-04-01
  ref <313>: RELEVANT RESIDUES IN SEQ ID NO: (1)..(1470)
gagggtttgatcctggctcagggcgaacgctggcggcgtgcctaacacatgcaagtcgagggggaaagggcacttcggtgcccgagtacaccggcagacgggtgagtaacgcgtgggtaacctaccttggggtctgggataaccacccgaaagggtggctaataccggatacgttcctgaggcgcgagccgagggaagaaagggtgccactgcatagcaagcacctgccccaagaggggcccgcgtcccatcagctagttggtgaggtaacggctcaccaaggcgacgacgggtagccggcctgagagggtggtcggccacactggcactgagacacgggccagactcctacgggaggcagcagtggggaatcttgggcaatggccgagaggctgacccagcgacgccgcgtgggggaagaaggccttcgggtcgtaaacccctgtcagggaggaagaaggcttacgggttaatagcccgtggagtttgacggtactcccagaggaagccacggctaactccgtgccagcagccgcggtaatacggaggtggcgagcgttgcccggaatcactgggcgtaaagggggcgtaggcggccggacaagtcggacgtgaaagcccggggctcaaccccggagttgcgttcgaaactgtttggcttgaggtccggagaggccggcggaattcccggtgtaggggtgaaatccgtagatatcgggaggaacaccggtggcgaaggcggccggctggacggcacctgacgctgaggcccgaaagcgtggggagcaaaccggattagatacccgggtagtccacgccgtaaacgatgggtgctaggtgtggggggttaaaccttccgtgccgaagctaacgcaataagcaccccgcctggggagtacggccgcaaggctgaaactcaaaggaattgacgggggcccgcacaagcggtggagcacgtggtttaattcgatgcaaagcgaagaaccttacctgggtttgacatgctaggggaccttccagagatgggagggtgcccgggcttagcctgggagccctagcacaggtgctgcatggctgtcgtcagctcgtgtcgtgagatgttgggttaagtcccgcaacgagcgcaaccctcgcccttagttgccagcgggtgaagccgggcactctagggggactgccggggacaacccggaggaaggaggggatgacgtcaagtcatcatggcccttatgcccagggctacacacgtgctacaatgggcggtacagagggaagcgaacccgcgagggggagcagatcccagaaagccgtcctcagttcggatcggggtctgcaactcgaccccgtgaagccggaatcgctagtaacggcggatcagcatgccgccgtgaatacgttcccgggccttgtacacaccgcccgtcacaccacggaagctggctctgcccgaagtcgctatcccaacccctt

SEQ ID NO: 9737 - DNA, 1206 bp, Thermodesulfatator autotrophicus
  ref <308>: DATABASE ACCESSION NUMBER: NCBI ACCESSION: NZ_LSFI01000105.1
  ref <309>: DATABASE ENTRY DATE: 2019-04-01
  ref <313>: RELEVANT RESIDUES IN SEQ ID NO: (1)..(1206)
gagggtttgatcctggctcagggcgaacgctggcggcgcgcctaacacatgcaagtcgagggggaaagggcggcttcggctgcccgagtacaccggcagacgggtgagtaacgcgtgggtaacctgccttggggtctgggataaccacccgaaagggtggctaataccggatacgttcctgaggtgcgagccgagggaagaaagggtgccgctgcatagcaagcacctgccctaagaggggcccgcgtcccatcagctagttggtgaggtaacggctcaccaaggcgacgacgggtagccggcctgagagggtggtcggccacactggcactgagacacgggccagactcctacgggaggcagcagtggggaatcttgggcaatggccgaaaggctgacccagcgacgccgcgtgggggaagaaggccttcgggtcgtaaacccctgtcaaggaggaagaagccctttctggttaagagctaggaggggttgacggtactcctggaggaagccacggctaactccgtgccagcagccgcggtaatacggaggtggcgagcgttgcccggaatcactgggcgtaaagggggcgtaggcggccggacgagtcggacgtgaaagcccggggctcaaccccggaattgcgttcgatactgtctggcttgaggtccggagaggccggcggaattcccggtgtaggggtgaaatccgtagatatcgggaggaacaccggtggcgaaggcggccggctggacggcacctgacgctgaggcccgaaagcgtggggagcaaaccggattagatacccgggtagtccacgccgtaaacgatgggtgctaggtgtggggggttagaccttccgtgccgaagctaacgcaataagcaccccgcctggggagtacggccgcaaggctgaaactcaaaggaattgacgggggcccgcacaagcggtggagcacgtggtttaattcgatgcaaagcgaagaaccttacctgggtttgacatgctaggggaccttccagagatgggagggtgcccgggttttacccgggagccctagcacaggtgctgcatggctgtcgtcagctcgtgtcgtgagatgttgggttaagtcccgcaacgagcgcaaccctcgcccttagttgccagcgggtagagccgggcactctagggggactgccggggacaacccggaggaagggggg

SEQ ID NO: 9738 - DNA, 1576 bp, Thermodesulfatator indicus
  ref <308>: DATABASE ACCESSION NUMBER: NCBI ACCESSION: NC_015681.1
  ref <309>: DATABASE ENTRY DATE: 2019-04-01
  ref <313>: RELEVANT RESIDUES IN SEQ ID NO: (1)..(1576)
gagggtttgatcctggctcagggcgaacgctggcggcgcgcctaacacatgcaagtcgagggggaaagggtagcttcggctacccgagtacaccggcagacgggtgagtaacgcgtgggtaacctaccttggggtctgggataaccacccgaaagggtggctaataccggatacgttcctgaggcgcgagccgagggaagaaagggtgccactgcatagcaagcacctgccctaagaggggcccgcgtcccatcagctagttggtgaggtaacggctcaccaaggcaacgacgggtagccggcctgagagggtggtcggccacactggcactgagacacgggccagactcctacgggaggcagcagtggggaatcttgggcaatggccgaaaggctgacccagcgacgccgcgtgggggaagaaggccttcgggtcgtaaacccctgtcaaggaggaagaagcccttactggttaagagctggtaggggttgacggtactcctggaggaagccacggctaactccgtgccagcagccgcggtaatacggaggtggcgagcgttgcccggaatcactgggcgtaaagggggcgtaggcggccggacgagtcggacgtgaaagcccggggctcaaccccggaattgcgttcgatactgtctggcttgaggtccggagaggccggcggaattcccggtgtaggggtgaaatccgtagatatcgggaggaacaccggtggcgaaggcggccggctggacggcacctgacgctgaggcccgaaagcgtggggagcaaaccggattagatacccgggtagtccacgccgtaaacgatgggtgctaggtgtggggggttaaaccttccgtgccgaagctaacgcaataagcaccccgcctggggagtacggccgcaaggctgaaactcaaaggaattgacgggggcccgcacaagcggtggagcacgtggtttaattcgatgcaaagcgaagaaccttacctgggtttgacatgctaggggacccctcagagatgagggggtgcccgggctttgcctgggagccctagcacaggtgctgcatggctgtcgtcagctcgtgtcgtgagatgttgggttaagtcccgcaacgagcgcaacccttgcccttagttgccagcgggtagagccgggcactctagggggactgccggggacaacccggaggaagggggggatgacgtcaagtcatcatggcccttatgcccagggctacacacgtgctacaatgggcggtacagagggaagcgaacccgtaagggggagcaaatcccagaaagccgctctcagtacggatcggggtctgcaactcgaccccgtgaagccggaatcgctagtaacggcggatcagcatgccgccgtgaatacgttcccgggccttgtacacaccgcccgtcacaccacgggagctggctctgcccgaagtcgctatcccaacccccggaagggggagggaggcgccgacggcagggctggtgactggggtgaagtcgtaacaaggtatccctaccggaaggtggggatggatcacctcctttctaaggag

SEQ ID NO: 9739 - DNA, 1023 bp, Thermodesulfitimonas autotrophica
  ref <308>: DATABASE ACCESSION NUMBER: NCBI ACCESSION: NZ_RKRE01000006.1
  ref <309>: DATABASE ENTRY DATE: 2019-04-01
  ref <313>: RELEVANT RESIDUES IN SEQ ID NO: (1)..(1023)
ttaatggagggtttgatcctggctcaggacgaacgctggcggcgtgcctaacacatgcaagtcgagcgggggtatagggtagcttgctaccttatgccttagcggcggacgggtgagtaacgcgtggataacctgcccgggagaccgggataactctgggaaactggagctaataccggatacgcttctgctggggcatcctggtggaaggaaagggattaccgctctcggatgggtccgcgtcccattagcttgttggcggggtaacggcccaccaaggcgacgatgggtagccggcctgagagggtggtcggccacactgggactgagacacggcccagactcctacgggaggcagcagtggggaatattccgcaatgggcgcaagcctgacggagcgacgccgcgtgggggacgaaggccttcgggttgtaaacccctgtcgtaggggaagatgcccctttggggtgacggtaccctacaagaaagccccggctaactacgtgccagcagccgcggtaagacgtagggggcgagcgttgtccggaatcactgggcgtaaagggcgtgtaggcggcttcagaagtcgcgggtgaaatctccaggctcaacctggaggctgcctgcgaaaccatggagcttgagggcaggagaggggagtggaattcccggtgtagcggtgaaatgcgtagatatcgggaggaacaccagtggcgaaggcggctctctggcctggccctgacgctgaggcgcgaaagctgggggagcaaacaggattagataccctggtagtcccagccgtaaacgatgggcactaggtgtgggggaggatctaactcttccgtgccgaaggtaacctattaagtgccccgcctggggagtacggccgcaaggttgaaactcaaaggaattgacgggggcccgcacaagcggtggagcatgtggtttaattcgacgcaacgcgaagaaccttaccagggcttgacatgccggtggtagtgaaccgaaaggggaacgacccat

SEQ ID NO: 9740 - DNA, 1583 bp, Thermodesulfobacterium commune
  ref <308>: DATABASE ACCESSION NUMBER: NCBI ACCESSION: NZ_JQLF01000011.1
  ref <309>: DATABASE ENTRY DATE: 2019-04-01
  ref <313>: RELEVANT RESIDUES IN SEQ ID NO: (1)..(1583)
ttccctgagggtttgatcctggctcagggcgaacgctagcggcgcgcctaacccatgcaagtcgagcgggaaagggtttcggccctagtaccgcggcagacgagtgagtaacacgtgagtaacctgtccccgggtctgggataactacccgaaagggtagctaataccggataaagtcaccggacgcaagttcggtgatgaaagggggcctctgcatagcaagctcctgcctggggaggggctcgcggcccatcagctagttggtggggtaatggcccaccaaggcgacgacgggtagccggcctgagagggtggtcggccacgcgggcactgagacacgggcccgactcctacgggaggcagcaggggggaatcttgggcaatgggcgaaagcctgacccagcgacgccgcgtgggggaagaaggccttcgggtcgtaaacccctgttctggaggaagaacccagggtaggtgaataacctatcctggctgacggtactccaggagaaagccacggctaactgcgtgccagcagccgcggtaatacgcaggtggcgagcgttgcccggaattactgggcgtaaagggtgcgtaggcggccggacaagtcataggttaaagcccggagctcaactccggaaaggcctatgatactgtctggcttgagggccggagaggctggcggaattcccggtgtaggggtgaaatccgtagatatcgggaggaacaccggtggggaagccggccagctggacggttcctgacgctgaggcacgaaagcgtggggagcaaaccggattagatacccgggtagtccacgccgtaaacgatgggcgctaggtgtgggggtgaaagcctctgtgccgtagctaacgcgttaagcgccccgcctggggagtacggccgcaaggctgaaactcaaaggaattgacgggggcccgcacaagcggtggagcacgtggtttaattcgatgcaaagcgaagaaccttacctgggcttgacatgctagggttgtaccctggtggaaacaccgggggagcgtaggggttatctctacgcgctctagcacaggtgctgcatggctgtcgtcagctcgtgtcgtgagatgttgggttaagtcccgcaacgagcgcaacccctgcccttagttgccatcggttcggccgggcactctaaggggactgccggggataacccggaggaaggaggggatgacgtcaagtcctcatggcccttatgcccagggctacacacgtgctacaatggggggtacagagggttgcgaacccgcaagggggagctaatcccagaaagccctcctcagttcggatcggggtctgcaactcgaccccgtgaagccggaatcgctagtaatggcggatcagcatgccgccgtgaatacgttcccgggccttgtacacaccgcccgtcacaccacggaagccggctccacccgaagtcgttaccctaaccgggcattgcctggagggggacgcctacggtggggctggtgactggggtgaagtcgtaacaaggtacccctaccggaaggtgggggtggatcacctcctttctaaggaga

SEQ ID NO: 9741 - DNA, 1584 bp, Thermodesulfobacterium geofontis
  ref <308>: DATABASE ACCESSION NUMBER: NCBI ACCESSION: NC_015682.1
  ref <309>: DATABASE ENTRY DATE: 2019-04-01
  ref <313>: RELEVANT RESIDUES IN SEQ ID NO: (1)..(1584)
ttttcctgagggtttgatcctggctcagggcgaacgctagcggcgcgcctaacccatgcaagtcgtgcgggaaaggggggtttttccccaagtaccgcggcaaacgggtgagtaacacgtgagtaacctgtcctcgggtctgggataaccacccgaaagggtggctaataccggataaagtcactgggcgcaagctcagtgatgaaagggggcctctgcatagcaagctcccgcctgaggaggggctcgcggcccatcagctagttggtggggtaacggcccaccaaggctaagacgggtagccggcctgagagggtggtcggccacacgggcactgagacacgggcccgactcctacgggaggcagcaggggggaatcttgggcaatgggcgcaagcctgacccagcgacgccgcgtgggggaagaaggccttcgggtcgtaaacccctgttctgggggaagaaccctgactgggttaagagcctagtcaggctgacggtaccccaggagaaagccacggctaactgcgtgccagcagccgcggtaatacgcaggtggcgagcgttgcccggaatcactgggcgtaaagggtgcgtaggcggctgggtaagtcgcaggttaaagcccggggcttaacctcggaaaggcctgcgatactgcctggcttgagggccggagaggctggcggaattcccggtgtaggggtgaaatccgtagatatcgggaggaacaccggtggggaagccggccagctggacggtccctgacgctgaggcacgaaagcgtggggagcaaaccggattagatacccgggtagtccacgccgtaaacgatgggtgctaggtctggggaggtaaactctctgggccgaagctaacgcgttaagcaccccgcctggggagtacggccgcaaggctgaaactcaaaggaattgacgggggcccgcacaagcggtggagcacgtggtttaattcgatgcaaagcgaagaaccttacctgggcttgacatgccagggttgtaccccggtggaaacactgggggagcgtaggggtttactctacgcgctctggcacaggtgctgcatggctgtcgtcagctcgtgtcgtgagatgttgggttaagtcccgcaacgagcgcaacccctgcccctagttgccagcgggtaatgccgggcactctagggggactgccggggataacccggaggaaggaggggatgacgtcaagtcctcatggcccttatgcccagggctacacacgtgctacaatggggggtacagagggatgcgaacccgcaagggggagctaatcccagaaagccctcctcagttcggatcggggtctgcaactcgaccccgtgaagccggaatcgctagtaatggcggatcagcatgccgccgtgaatacgttcccgggccttgtacacaccgcccgtcacaccacggaagctggtcccacccgaagtcactaccctaacctggcttcagctgggaggggggtgcctacggtggggccggtgactggggtgaagtcgtaacaaggtacccctaccggaaggtgggggtggatcacctcctttcta

SEQ ID NO: 9742 - DNA, 1581 bp, Thermodesulfobacterium hveragerdense
  ref <308>: DATABASE ACCESSION NUMBER: NCBI ACCESSION: NZ_AUIT01000020.1
  ref <309>: DATABASE ENTRY DATE: 2019-04-01
  ref <313>: RELEVANT RESIDUES IN SEQ ID NO: (1)..(1581)
ccctgagggtttgatcctggctcagggcgaacgctagcggcgcgcttaacccatgcaagtcgtgcgggaaagggcttcggccctagtaccgcggcagacgagtgagtaacacgtgagtaacctgtcctcgggtctgggataactatccgaaagggtagacaataccggataaagtcaccggacgcaagttcggtgatgaaagggggcctctgcatagcaagctcctgcctgaggaggggctcgcggcccatcagctagttggtgaggtaacggctcaccaaggctacgacgggtagccggcctgagagggtggtcggccacgcgggcactgagacacgggcccgactcctacgggaggcagcaggggggaatcttgggcaatgggcgaaagcctgacccagcgacgccgcgtgggggaagaaggccttcgggtcgtaaacccctgttctggaggaagaacttcagataggtgaacaacctatctgaactgacggtacttcaggagaaagccacggctaactgcgtgccagcagccgcggtaatacgcaggtggcgagcgttgcccggaatcactgggcgtaaagggtgcgtaggcggctggacaagtcataggttaaagcccggagctcaactccggaaaggcctatgatactgtctggcttgagggccggagaggctggcggaattcccggtgtaggggtgaaatccgtagatatcgggaggaacaccggtggggaagcctgccagctggacggatcctgacgctgaggcacgaaagcgtggggagcaaaccggattagatacccgggtagtccacgccgtaaacgatgggcgctaggtgtgggggttaaaacctctgtgccgtagctaacgcgttaagcgccccgcctggggagtacggccgcaaggctgaaactcaaaggaattgacgggggcccgcacaagcggtggagcacgtggtttaattcgatgcaaagcgaagaaccttacctgggtttgacatgctagggttgtaccctggtggaaacactgggggagcgtagggtttatctctacgcgctctagcacaggtgctgcatggctgtcgtcagctcgtgtcgtgagatgttgggttaagtcccgcaacgagcgcaacccctgcccttagttgccatcggttcggccgggcactctaaggggactgccggggataacccggaggaaggaggggatgacgtcaagtcctcatggcccttatgcccagggctacacacgtgctacaatggggggtacagagggttgcgaacctgcaagggggagctaatcccagaaagccctcctcagttcggatcggggtctgcaactcgaccccgtgaagccggaatcgctagtaatggcggatcagcatgccgccgtgaatgcgttcccgggccttgtacacaccgcccgtcacaccacggaagctggctccacccgaagtcgttaccctaaccaggctctgtctggagggggacgcctacggtggggctggtgactggggtgaagtcgtaacaaggtacccctaccggaaggtgggggtggatcacctcctttctaaggaga

SEQ ID NO: 9743 - DNA, 1581 bp, Thermodesulfobacterium hydrogeniphilum
  ref <308>: DATABASE ACCESSION NUMBER: NCBI ACCESSION: NZ_JQKW01000013.1
  ref <309>: DATABASE ENTRY DATE: 2019-04-01
  ref <313>: RELEVANT RESIDUES IN SEQ ID NO: (1)..(1581)
cctgagggtttgatcctggctcagggcgaacgctagcggcgcgcctaacccatgcaagtcgtgcgggaaagggtttcgacccaagtaccgcggcagacgggtgagtaacacgtgagtaacctgtccccgggtctgggataaccacccgaaagggtggctaataccggataaagtcaccaggcgcaagtctggcgatgaaaggggggcctctgcatagcaagctcctgcctggggaggggctcgcggcccatcaggtagttggtggggtaacggcccaccaagcctacgacgggtagccggcctgagagggtggtcggccacacgggcactgagacacgggcccgactcctacgggaggcagcaggggggaatcttgggcaatgggcgcaagcctgacccagcgacgccgcgtgggggaagaaggccttcgggtcgtaaacccctgttctgggggaagaaccctggtttagtgaatagctaagccaggctgacggtaccccaggagaaagccacggctaactgcgtgccagcagccgcggtaatacgcaggtggcgagcgttgcccggaatcactgggcgtaaagggtgcgtaggcggccggacaagtcgtaggtcaaagcccggagctcaactccggaaaggcctacgatactgtctggcttgagggccggagaggctggcggaattcccggtgtaggggtgaaatccgtagatatcgggaggaacaccggtggggaagccggccagctggacggttcctgacgctgaggcacgaaagcgtggggagcaaaccggattagatacccgggtagtccacgccgtaaacgatgggcgctaggtgtggggggttaaaccctccgtgccgaagctaacgcgttaagcgccccgcctggggagtacggccgcaaggctgaaactcaaaggaattgacgggggcccgcacaagcggtggagcacgtggtttaattcgatgcaaagcgaagaaccttacctgggcttgacatgccagggttgtaccccggtggaaacactgggggagcctgagatttttctcaggcgctctggcacaggtgctgcatggctgtcgtcagctcgtgtcgtgagatgttgggttaagtcccgcaacgagcgcaacccctgcccctagttgccagcgggtaatgccgggcactctagggggactgccggggataacccggaggaaggaggggatgacgtcaagtcctcatggcccttatgcccagggctacacacgtgctacaatggggggtacagagggttgcgaacccgtaagggggagctaatcccagaaagccctcctcagttcggatcggggtctgcaactcgaccccgtgaagccggaatcgctagtaatggcggatcagcatgccgccgtgaatacgttcccgggccttgtacacaccgcccgtcacaccacggaagccggtcctacccgaagtcgctaccctaacctgcttcagcaggaggggggcgcctacggtagggctggtgactggggtgaagtcgtaacaaggtacccctaccggaaggtgggggtggatcacctcctttctaaggaga

SEQ ID NO: 9744 - DNA, 1575 bp, Thermodesulfobacterium thermophilum
  ref <308>: DATABASE ACCESSION NUMBER: NCBI ACCESSION: NZ_ATXI01000006.1
  ref <309>: DATABASE ENTRY DATE: 2019-04-01
  ref <313>: RELEVANT RESIDUES IN SEQ ID NO: (1)..(1575)
ccctgagggtttgatcctggctcagggcgaacgctagcggcgcgcctaacccatgcaagtcgagcgggaaagggcttcggccctagtaccgcggcagacgagtgagtaacacgtgagtaacctgtcctcgggtctgggataactacccgaaagggtagacaataccggataaagtcaccggacgcaagttcggtgatgaaagggggcctctgcatagcaagctcctgcctgaggaggggctcgcggcccatcagctagttggtgaggtaacggctcaccaaggctacgacgggtagccggcctgagagggtggtcggccacgcgggcactgagacacgggcccgactcctacgggaggcagcaggggggaatcttgggcaatgggcgaaagcctgacccagcgacgccgcgtgggggaagaaggccttcgggtcgtaaacccctgttctggaggaagaacttcagataggtgaacagcctatctgaactgacggtactccaggagaaagccacggctaactgcgtgccagcagccgcggtaatacgcaggtggcgagcgttgcccggaatcactgggcgtaaagggtgcgtaggcggccggataagtcataggttaaagcccggagctcaactccggaaaagcctatgatactgtctggcttgagggccggagaggctggcggaattcccggtgtaggggtgaaatccgtagatatcgggaggaacaccggtggggaagcctgccagctggacggatcctgacgctgaggcacgaaagcgtggggagcaaaccggattagatacccgggtagtccacgccgtaaacgatgggcgctaggtgtgggggttaaaacctctgtgccgtagctaacgcgttaagcgccccgcctggggagtacggccgcaaggctgaaactcaaaggaattgacgggggcccgcacaagcggtggagcacgtggtttaattcgatgcaaagcgaagaaccttacctgggtttgacatgctagggttgtaccctggtggaaacatcgggggagcgtagggtttatctctacgcgctctagcacaggtgctgcatggctgtcgtcagctcgtgtcgtgagatgttgggttaagtcccgcaacgagcgcaacccctgcccttagttgccatcggttcggccgggcactctaaggggactgccggggataacccggaggaaggaggggatgacgtcaagtcctcatggcccttatgcccagggctacacacgtgctacaatggggggtacagagggttgcgaacccgcaagggggagctaatcccagaaagccctcctcagttcggatcggggtctgcaactcgaccccgtgaagccggaatcgctagtaatggcggatcagcatgccgccgtgaatgcgttcccgggccttgtacacaccgcccgtcacaccacggaagctggctccacccgaagtcgttaccctaaccgggctttgcctggaggggggcgcctacggtggggctggtgactggggtgaagtcgtaacaaggtacccctaccggaaggtgggggtggatcacctcctttcta

SEQ ID NO: 9745 - DNA, 1525 bp, Thermodesulfobium acidiphilum
  ref <308>: DATABASE ACCESSION NUMBER: NCBI ACCESSION: NZ_CP020921.1
  ref <309>: DATABASE ENTRY DATE: 2019-04-01
  ref <313>: RELEVANT RESIDUES IN SEQ ID NO: (1)..(1525)
tatggagggtttgatcctggctcaggacgaacgctggcggcgtgcctaacacatgcaagtcgaacggagatagaagcttgcttctatcttagtggcaaacgggtgagtaacgcgtgggtaacctacccttaagtgggggataacaggtcgaaaggcctgctaataccgcatacctttcaagcacacaagtgtttgaaagaaaggagcaatccgcttgaggaggggcctgcgtcctatcaggtagttggtgaggtaatggctcaccaagcctatgacgggtagctggtctgagaggatggtcagccacactggaactgagacacggtccagactcctacgggaggcagcagtggggaatattccgcaatgggcgaaagcctgacggagcgacgccgcgtggacgatgaagaccctatgggttgtaaagtccttttgtgagggaagaagatctgacggtacctcacgaataagccacggctaactacgtgccagcagccgcggtaaaacgtaggtggcaagcgttgtccggaattactgggcgtaaagagtgcgtaggctgttttgtaagtctcaggtgaaatctatcagctcaactgataaactgcttgagatactgcagaacttgagggcaggagaggagagtggaattcccggtgtagcggtgaaatgcgtagatatcgggaggaacaccagtggcgaaggcggctctctggactgtccctgacgctgtggcacgaaagctaggggagcaaacaggattagataccctggtagtcctagccgtaaacgatggatgcttggtgtaggaggttataccttctgtgccgaagctaacgcgttaagcatcccgcctgggaactacggccgcaaggttaaaactcaaaggaattgacgggggcccgcacaagcggtggagcatgtggtttaattcgacgcaacgcgaagaaccttaccagggcttgacatgtaagtggtacggatccgaaaggtgaaggaaccgagcttgctcggtagcttacacaggtggtgcatggctgtcgtcagctcgtgccgtgaggtgttgggttaagtcccgcaacgagcgcaacccctatcgttagttgctactctgaaaaagagaggactctaatgagactgccggcgataagccggaggaaggaggggacgacgtcaagtcatcatgccctttatgccctgggcgacacacgtgctacaatggctggtacaacgggttgcaacaaagcgatttggagccaatcccttaaagccagcctcagttcggatcgtaggctgaaactcgcctacgtgaagtcggaatcgctagtaatcgccaatcagccacgtggcggtgaatacgttcccgggccttgtacacaccgcccgtcacaccacggaagctggcaatgcccgaagccgctgacccaaccattaggagggaggcgtcgaaggcagggtcggtgactggggtgaagtcgtaacaaggtagccgtacgggaacgtgcggctggatcacctcctttctaag

SEQ ID NO: 9746 - DNA, 1523 bp, Thermodesulfobium narugense
  ref <308>: DATABASE ACCESSION NUMBER: NCBI ACCESSION: NC_015499.1
  ref <309>: DATABASE ENTRY DATE: 2019-04-01
  ref <313>: RELEVANT RESIDUES IN SEQ ID NO: (1)..(1523)
tatggagggtttgatcctggctcaggacgaacgctggcggcgtgcctaacacatgcaagtcgaacggagatagaagcttgcttctatcttagtggcaaacgggtgagtaacgcgtgggtaacctacccttaagtgggggataacaggtcgaaaggcctgctaataccgcatacctttcaagcacacaagtgtttgaaagaaaggagtaatccgcttgaggaggggcctgcgtcctatcaggtagttggtgaggtaacggctcaccaagcctatgacgggtagctggtctgagaggatggtcagccacactggaactgagacacggtccagactcctacgggaggcagcagtggggaatattccgcaatgggcgaaagcctgacggagcgacgccgcgtggacgatgaagaccctatgggtcgtaaagtccttttgtgagggaagaagctctgacggtacctcacgaataagccacggctaactacgtgccagcagccgcggtaaaacgtaggtggcaagcgttgtccggaattactgggcgtaaagagtgcgtaggctgttttgtaagtctcaggtgaaatctatcagctcaactgataaactgcttgagatactgcagaacttgagggcaggagaggagagtggaattcccggtgtagcggtgaaatgcgtagatatcgggaggaacaccagtggcgaaggcgactctctggactgtccctgacgctgtggcacgaaagctaggggagcaaacaggattagataccctggtagtcctagccgtaaacgatggatgcttggtgtaggaggttataccttctgtgccgaagctaacgcgttaagcatcccgcctgggaactacggccgcaaggttaaaactcaaaggaattgacgggggcccgcacaagcggtggagcatgtggtttaattcgacgcaacgcgaagaaccttaccagggtttgacatgtaagtggtacggatccgaaaggtgaaggaaccgagcttgctcggtagcttacacaggtggtgcatggctgtcgtcagctcgtgccgtgaggtgttgggttaagtcccgcaacgagcgcaacccctatcgttagttactactcgaaaagagaggactctaatgagactgccggcgataagccggaggaaggaggggacgacgtcaagtcatcatgccctttatgccctgggcgacacacgtgctacaatggctggtacaacgggttgcaacaaagcgatttggagccaatcccttaaagccagcctcagttcggatcgtaggctgaaactcgcctacgtgaagtcggaatcgctagtaatcgccaatcagccacgtggcggtgaatacgttcccgggccttgtacacaccgcccgtcacaccacggaagctggcaatgcccgaagccgctgacccaaccattaggagggaggcgtcgaaggcagggtcggtgactggggtgaagtcgtaacaaggtagccgtacgggaacgtgcggctggatcacctcctttctaag

SEQ ID NO: 9747 - DNA, 1541 bp, Thermodesulfovibrio aggregans
  ref <308>: DATABASE ACCESSION NUMBER: NCBI ACCESSION: NZ_BCNO01000001.1
  ref <309>: DATABASE ENTRY DATE: 2019-04-01
  ref <313>: RELEVANT RESIDUES IN SEQ ID NO: (1)..(1541)
tatatgagagtttgatcctggctcagagcgaacgctggcggcgtgcctaacacatgcaagtcgagcggactacatgaaggggtaactcttcatgtagttagcggcgaacgggtgagtaacacgtgggtaacctaccctcaggtgggggataactcggggaaacctgagctaataccccataagactacgggctgaaaggcttgtagtaaaagaagcaattcgcctgaggatgggcccgcggcctatcaggtagttggtagggtaatggcctaccaagcctatgacgggtagccgagctgagaggctggccggccacactgggactgagacacggcccagactcctacgggaggcagcagtggggaatcttgggcaatgggcgaaagcctgacccagcgacgccgcgtgggggaagaaggccttcgggttgtaaaccccttttgcaggggacgacacaggacggtaccctgcgaataagccacggctaactctgtgccagcagccgcggtaagacagaggtggcgagcgttgctcggatttactgggcttaaagggcgcgtaggtggccttgtaagtcaaaggtggaattccacagctcaactgtggaactgcctttgatactgcaaggcttgagtcaggtagaggagggcggaattcccggtgtagcggtgaaatgcgtagatatcgggaggaaggccggtggcgaaggcggccctctgggcctgtactgacactgaggcgcgaaagcgtggggagcaaacaggattagataccctggtagtccacgccctaaacggtgggcactaggtgtgggatccgtatggattccgtgccgaagggaaaccattaagtgccccgcctggggagtacggccgcaaggttgaaactcaaaggaattgacgggggcccgcacaagcggtggagcatgtggtttaattcgatgcaacgcgaagaaccttacctgggcttgacatgctggtggtaggaacccgaaagggggacgaccttaggggaaaccctaaggagccagcacaggtgctgcatggctgtcgtcagctcgtgccgtgaggtgttgggttaagtcccgcaacgagcgcaacccctatcccctgttgccagcggataatgccgggcactctggggaaactgccggcgacaagccggaggaaggtggggatgacgtcaagtccgcatggcccttatgcccagggctacacacgtgctacaatgggcgctacaaagggttgcgaacccgcgagggggagccaatccctaaaaagcgctctcagttgggatcggagtctgcaactcgactccgtgaacccggaatcgctagtaatcgcgcatcagctacggcgcggtgaatacgttcccgggccttgtacacaccgcccgtcacaccacgagagctggcttcatccgaagttggtgggctaacccgcaagggaggcagccaacgaagatggggctggtgattggggtgaagtcgtaacaaggtagccgtaggggaacctgtggctggatcacctcctttctaagga

SEQ ID NO: 9748 - DNA, 1541 bp, Thermodesulfovibrio islandicus
  ref <308>: DATABASE ACCESSION NUMBER: NCBI ACCESSION: NZ_AXWU01000024.1
  ref <309>: DATABASE ENTRY DATE: 2019-04-01
  ref <313>: RELEVANT RESIDUES IN SEQ ID NO: (1)..(1541)
tatatgagagtttgatcctggctcagagcgaacgctggcggcgtgcctaacacatgcaagtcgagcggaccagaaatggaggtaactttatttctggttagcggcgaacgggtgagtaacacgtgggtaacctgccctcaggaggaggataactcggggaaacctgagctaatactccataagaccacgagctgaaatgcttgtggtaaaagaagcaattcacctgaggatgggcccgcggcctatcaggtagttggtagggtaatggcctaccaagcctatgacgggtagccgagctgagaggctggccggccacactgggactgagacacggcccagactcctacgggaggcagcagtggggaatattgggcaatgggcgaaagcctgacccagcgacgccgcgtgggggaagaaggccttcgggttgtaaaccccttttgcaggggacgacacaggacggtaccctgcgaataagccacggctaactctgtgccagcagccgcggtaagacagaggtggcaagcgttgctcggattcactgggcttaaagggcgcgtaggtggttttgtaagtctaaggtggaattccacagcttaactgtgggactgcctttgatactgcaaggcttgagtcaggcagaggagggcggaattcccggtgtagcggtgaaatgcgtagatatcgggaggaaggcctgtggcgaaggcggccctctgggcctgcactgacactgaggcgcgaaagcgtggggagcaaacaggattagataccctggtagtccacgccctaaacggtgggcactaggtgtggggtccatatggactctgtgccgaagggaaaccattaagtgccccgcctggggagtacggccgcaaggttgaaactcaaaggaattgacggggggccgcacaagcggtggagcatgtggtttaattcgatgcaacgcgaagaaccttacctgggcttgacatgctggtggtaggaacccgaaagggggacgaccttaggggtaactctaaggagccagcacaggtgctgcatggctgtcgtcagctcgtgccgtgaggtgttgggttaagtcccgcaacgagcgcaacccctatcccctgttgccatcaggtaaagctgggcactctggggaaactgccggcgacaagccggaggaaggtggggatgacgtcaagtccgcatggcccttatgtccagggctacacacgtgctacaatgggcgctatagagggtagcaaacccgcgagggtgagccaatccctaaaaagcgctctcagttgggatcggagtctgcaattcgactccgtgaacccggaatcgctagtaatcgcgcatcagctacggcgcggtgaatacgttcccgggccttgtacacaccgcccgtcacaccacgagagctggcttcatccgaagttggtgagctaacccgtaagggaggcagccaacgaagatggggctggtgattggggtgaagtcgtaacaaggtagccgtaggggaacctgtggctggatcacctcctttctaagga

SEQ ID NO: 9749 - DNA, 1543 bp, Thermodesulfovibrio sp. N1
  ref <308>: DATABASE ACCESSION NUMBER: NCBI ACCESSION: NZ_MAVV01000012.1
  ref <309>: DATABASE ENTRY DATE: 2019-04-01
  ref <313>: RELEVANT RESIDUES IN SEQ ID NO: (1)..(1543)
tatatgagagtttgatcctggctcagagcgaacgctggcggcgtgcctaacacatgcaagtcgagcggactataggaaggggtaactcttcctatagttagcggcgaacgggtgagtaacacgtgggtaacctgcccttaggaaggggataactcggggaaacctgagctaataccctataagaccacgagctgaaaggcttgtggtaaaaggagaaatccacctaaggatgggcccgcggcctatcaggtagttggtagggtaatggcctaccaagcctatgacgggtagccgagctgagaggctggccggccacactgggactgagacacggcccagactcctacgggaggcagcagtggggaatattgggcaatgggcgaaagcctgacccagcgacgccgcgtgggggaagaaggccttcgggttgtaaaccccttttgcaggggacgacacaggacggtaccctgcgaataagccacggctaactctgtgccagcagccgcggtaagacagaggtggcaagcgttgctcggattcactgggcttaaagggcgcgtaggcggctttgtaagtctaaggtggaattccacagctcaactgtggaactgccttggaaactgcaaagcttgagtcaggtagaggagggcggaattcccggtgtagcggtgaaatgcgtagatatcgggaggaaggccggtggcgaaggcggccctctgggcctgtactgacgctgaggcgcgaaagcgtggggagcaaacaggattagataccctggtagtccacgccctaaacggtgggcactaggtgtggggtccgtatggactctgtgccgaagggaaaccattaagtgccccgcctggggagtacgaccgcaaggttgaaactcaaaggaattgacgggggcccgcacaagcggtggagcatgtggtttaattcgatgcaacgcgaagaaccttacctgggcttgacatgctggtggtaggaacccgaaagggggacgaccttaggggcaactctaaggagccagcacaggtgctgcatggctgtcgtcagctcgtgccgtgaggtgttgggttaagtcccgcaacgagcgcaacccctatcccctgttgccagcggataatgccgggcactctggggaaactgccggcgacaagccggaggaaggtggggatgacgtcaagtccgcatggcccttatgtccagggctacacacgtgctacaatgggcgctacagagggttgcaaacccgcgagggggagccaatccctaaaaagcgctctcagttgggatcggagtctgcaactcgactccgtgaacccggaatcgctagtaatcgcgcatcagctacggcgcggtgaatacgttcccgggccttgtacacaccgcccgtcacaccacgagagctggcttcatccgaagttggtgagctaacccgtaagggaggcagccaacgaagatggggctggtgattggggtgaagtcgtaacaaggtagccgtaggggaacctgtggctggatcacctcctttctaaggaga

SEQ ID NO: 9750 - DNA, 1541 bp, Thermodesulfovibrio thiophilus
  ref <308>: DATABASE ACCESSION NUMBER: NCBI ACCESSION: NZ_AUIU01000004.1
  ref <309>: DATABASE ENTRY DATE: 2019-04-01
  ref <313>: RELEVANT RESIDUES IN SEQ ID NO: (1)..(1541)
tatatgagagtttgatcctggctcagagcgaacgctggcggcgtgcctaacacatgcaagtcgagcgaaccaggagtaaaggtaactttgttcttggttcgcggcgaacgggtgagtaacacgtgggtaacctgccctcaggagggggataactcggggaaacttgagataataccccataagaccacaagctgagatgcttgtggtaaaaggagcaatccacctgaggatgggcccgcggcctatcaggtagttggtagggtaatggcctaccaagcctatgacgggtagccgagctgagaggctggccggccacactgggactgagacacggtccagactcctacgggaggcagcagtggggaatattgggcaatgggcgaaagcctgacccagcgacgccgcgtgggggaagaaggccttcgggttgtaaaccccttttgcagaggacgactaaagactgtactctgcgaataagccacggctaactctgtgccagcagccgcggtaagacagaggtggcaagcgttgctcggattcactgggcttaaagggcgcgtaggtggccttgcaagtctgaggtgtaatttcatagcttaactatggaactgcctttgaaactgcaaggcttgagtcaggtagaggaaggcggaattcccggtgtagcggtgaaatgcgtagatatcgggaagaaggccggtggcgtaggcggccttctgggcctgcactgacactgaggcgcgaaagcgtggggagcaaacaggattagataccctggtagtccacgccctaaacggtgggcactaggtgtagggtctatatagactctgtgccgaagggaaaccattaagtgccccgcctggggagtacggccgcaaggttgaaactcaaaggaattgacgggggcccgcacaagcggtggagcatgtggtttaattcgatgcaacgcgaagaaccttacctgggcttgacatgctggtggtagaaacccgaaagggggacgaccttaggggtaactctaaggagccagcacaggtgctgcatggctgtcgtcagctcgtgccgtgaggtgttgggttaagtcccgcaacgagcgcaacccctatctcctgttgccaacggataatgccgggcactctggagaaactgccggcgacaagccggaggaaggtggggatgacgtcaagtccgcatggcccttatgtccagggctacacacgtgctacaatgggtgttacagagggttgcaaacccgcgagggtgagccaatcccttaaaaacactctcagttgggatcggagtctgcaattcgactccgtgaacccggaatcgctagtaatcgcgcatcagctacggcgcggtgaatacgttcccgggccttgtacacaccgcccgtcacaccacgagagctggtttcatccgaagttgatgagctaacccgcaagggaggcagtcaacgaagatggggctggtgattggggtgaagtcgtaacaaggtagccgtaggggaacctgtggctggatcacctcctttctaagga

SEQ ID NO: 9751 - DNA, 1493 bp, Thermodesulfovibrio yellowstonii
  ref <308>: DATABASE ACCESSION NUMBER: NCBI ACCESSION: NC_011296.1
  ref <309>: DATABASE ENTRY DATE: 2019-04-01
  ref <313>: RELEVANT RESIDUES IN SEQ ID NO: (1)..(1493)
agagtttgatcctggctcagagcgaacgctggcggcgtgcctaacacatgcaagtcgagcggaccagaaatggaggtaactttatttctggttagcggcgaacgggtgagtaacacgtgggtaacctgccctcaggaggaggataactcggggaaacctgagctaatactccataagaccacgagctgaaatgcttgtggtaaaagaagcaattcacctgaggatgggcccgcggcctatcaggtagttggtagggtaatggcctaccaagcctatgacgggtagccgagctgagaggctggccggccacactgggactgagacacggcccagactcctacgggaggcagcagtggggaatattgggcaatgggcgaaagcctgacccagcgacgccgcgtgggggaagaaggccttcgggttgtaaaccccttttgcaggggacgacacaggacggtaccctgcgaataagccacggctaactctgtgccagcagccgcggtaagacagaggtggcaagcgttgctcggattcactgggcttaaagggcgcgtaggtggttttgtaagtctaaggtggaattccacagcttaactgtgggactgcctttgatactgcaaggcttgagtcaggcagaggagggcggaattcccggtgtagcggtgaaatgcgtagatatcgggaggaaggcctgtggcgaaggcggccctctgggcctgcactgacactgaggcgcgaaagcgtggggagcaaacaggattagataccctggtagtccacgccctaaacggtgggcactaggtgtggggtccatatggactctgtgccgaagggaaaccattaagtgccccgcctggggagtacggccgcaaggttgaaactcaaaggaattgacgggggcccgcacaagcggtggagcatgtggtttaattcgatgcaacgcgaagaaccttacctgggcttgacatgctggtggtaggaacccgaaagggggacgaccttaggggtaactctaaggagccagcacaggtgctgcatggctgtcgtcagctcgtgccgtgaggtgttgggttaagtcccgcaacgagcgcaacccctatcccctgttgccatcaggtaaagctgggcactctggggaaactgccggcgacaagccggaggaaggtggggatgacgtcaagtccgcatggcccttatgtccagggctacacacgtgctacaatgggcgctatagagggtagcaagcccgcgagggtgagccaatccctaaaaagcgctctcagttgggatcggagtctgcaattcgactccgtgaacccggaatcgctagtaatcgcgcatcagctacggcgcggtgaatacgttcccgggccttgtacacaccgcccgtcacaccacgagagctggcttcatccgaagttggtgagctaacccgtaagggaggcagccaacgaagatggggctggtgattggggtgaagtcgtaacaaggta

SEQ ID NO: 9752 - DNA, 1535 bp, Thermoflavifilum aggregans
  ref <308>: DATABASE ACCESSION NUMBER: NCBI ACCESSION: NZ_PGFG01000001.1
  ref <309>: DATABASE ENTRY DATE: 2019-04-01
  ref <313>: RELEVANT RESIDUES IN SEQ ID NO: (1)..(1535)
ttacaatggagagtttgatcctggctcaggatgaacgctagcggcaggcctaatacatgcaagtcgtggggtaaccctgcagcaatgtggggctagaccggcaaacgggtgagtaacacgtacgcaacctgcctctaactggaggatagcccctcgaaagagggattaatactccataaagttacggaagggcatccttctgtaaccaaagctccggcggttagagaggggcgtgcgtcccattaggtagttggtagggtaacggcctaccaagccgacgatgggtagctggcgtgagagcgcgaccagccacacgggcactgagacacgggcccgactcctacgggaggcagcagtaaggaatattggtcaatgggcgcaagcctgaaccagccatgccgcgtgcaggatgaaggccctcagggttgtaaactgcttttctcagggaagaaacccccgttttccaacggggttgacggtacctgaggaataagcaccggctaactccgtgccagcagccgcggtaatacggagggtgcaagcgttatccggattcactgggtttaaagggtgtgtaggcgggcaggtaagtcagcggtgaaagccccgagcttaacttgggaattgccgttgatactatctgtcttgaatgttgtggaggcgagcggaatatggcatgtagcggtgaaatgcttagatatgccatagaacaccgattgcgaaggcagctcgctacgcaaccattgacgctgaggcacgaaagcgtggggagcaaacaggattagataccctggtagtccacgccctaaacgatgatcactcgacattggcgatacactgtcagtgtctaagcgaaagcattaagtgatccacctggggagtacgaccgcaaggttgaaactcaaaggaattgacgggggtccgcacaagcggtggagcatgtggtttaattcgatggtacgcgaggaaccttacctgggctagaatgccgggggacagggagtgaaagctccccttcccgcaagggaccgtcggcaaggtgctgcatggctgtcgtcagctcgtgccgtgaggtgttgggttaagtcccgcaacgagcgcaaccctcatcactagttgccatcaggttatgctgggaactctagtgaaactgccgtcgtaagacgtgaggaaggaggggacgacgtcaagtcatcatggcctttatgcccagggctacacacgtgctacaatggcgagtacaaagggctgctacctggcgacaggacgctaatcccaaaaaactcgtctcagtacggattgcagtctgcaactcgactgcatgaagctggaatcgctagtaatcgcgcatcagcaatggcgcggtgaatacgttcccggaccttgtacacaccgcccgtcaagccatgggagccgggtgtacctgaagtcggtaaccgcaaggagccgcctagggtaaaaccggtgactggggctaagtcgtaacaaggtagccgtaccggaaggtgcggctggaatacctcctttttagagct

SEQ ID NO: 9753 - DNA, 1521 bp, Thermogemmatispora carboxidivorans
  ref <308>: DATABASE ACCESSION NUMBER: NCBI ACCESSION: NZ_JNIM01000001.1
  ref <309>: DATABASE ENTRY DATE: 2019-04-01
  ref <313>: RELEVANT RESIDUES IN SEQ ID NO: (1)..(1521)
ggatggcgagtttgatcctggctcaggacgaacgctggcggcgtgcctaacacatgcaagtcgaacgtcctttccgcgaggggagggcgtggcggacgggtgaggaacacgtgggtgacctgccctgcagtgggggataccggtgcgaaagcgccgacaatcccgcatacggtggcgtcttgcaagaggcgccaggaaagctccgcgccggagggcgtggggcgctgcaggaggggcctgcgcccgattagctggttggtagggtaacggcctaccaaggcgacgatcggtcgctggtctgagaggacgaccagccacactgggattgagagacggcccagactcctacggggggcagcagtgagggatcttcggcaatgggcgaaagcctgaccgagcgacgccgcgtgcaggaagaaggccttcgggttgtaaactgcttttctgggggaagagagaggacggtaccccaggaagaagccccggcaaactacgtgccagcagccgcggtaagacgtagggggcgagcgttgtccggagttactgggcgtaaagggcctgtaggcggtcgggcaggttccggctgacagcccgcggcttcactgcgggagaggcaggaagacggtccgacttgagggccacagagggacagggaattcccggtggagcggtgaaatgcgtagagatcgggaagaacaccgaaggcgaaggcactgtcctgggtggtacctgacgctgagaggcgaaagctaggggagcgaacgggattagataccccggtagtcctagccgtaaacgctgaccactaggtgtgtggggagatcgaccccctgcgcgccgaagcgaacgcatgaagtggtccgcctggggagtacggccgcaaggctaaaactcaaaggaattgacggggacccgcacaagcagcggagcgtgtggtttaattcgatgcaacgcgaagaaccttaccagggttggacaagcgcgctgagggtccagagatgggccggcccgcaagggaggcgcgctcaggtgctgcatggctgtcgtcagctcgtgccgtgaggtgttgggttaagtcccgcaacgagcgcaacccccgctctcggttggaattctccgaggggactgccgcgcacaacgcggaggaaggtggggatgacgtcaagtcagcatggccctgacatcctgggcgacacacacgctacaatggtcgggacagcgggcagcgacccggcgacggggagccaatcccttaaacccgatctcagtgcagattgcaggctgcaacccgcctgcatgaaggaggagttgctagtaaccgccggtcagcacacggcggtgaatacgttctcgggtcttgtacacaccgcccgtcacaccacgaaagccggcaacacctgaagccgctgggcgaacccctcaagagaggggaggcaggcgtcgagggtggggtcggtgattggggtgaagtcgtaacaaggtagccgtaccggaaggtgcggctggatcacctcctttcta

SEQ ID NO: 9754 - DNA, 1295 bp, Thermogemmatispora onikobensis
  ref <308>: DATABASE ACCESSION NUMBER: NCBI ACCESSION: NZ_BDGT01000110.1
  ref <309>: DATABASE ENTRY DATE: 2019-04-01
  ref <313>: RELEVANT RESIDUES IN SEQ ID NO: (1)..(1295)
cagtgggggataccggtgcgaaagtgccgacaatcccgcatacggtggtgtcttgcaagaggcaccaggaaagctttctgccggagggcgggaggcgctgcaggaggggcctgcgcccgattagctagttggtggggtaatggcccaccaaggcgacgatcggtagctggtctgagaggacgatcagccacactgggattgagagacggcccagactcctacggggggcagcagtgagggatcttcggcaatgggcgaaagcctgaccgagcgacgccgcgtgcaggaagacggccttcgggttgtaaactgcttttctgggggaagagagaggacggtaccccaggaagaagccccggcaaactacgtgccagcagccgcggtaagacgtagggggcgagcgttgtccggagttactgggcgtaaagggcctgtaggcggtcgggcaggttccggctgacagcccgcggcttcactgcgggagaagcaggaagacggtctgacttgagggccacagagggacagggaattcccggtggagcggtgaaatgcgtagagatcgggaagaacaccgaaggcgaaggcactgtcctgggtggtacctgacgctgagaggcgaaagctaggggagcgaacgggattagataccccggtagtcctagccgtaaacgctgaccactaggtgtgtggggagatcgaccccctgcgcgccgaagcgaacgcatgaagtggtccgcctggggagtacggccgcaaggctaaaactcaaaggaattgacggggacccgcacaagcagcggagcgtgtggtttaattcgatgcaacgcgaagaaccttaccagggttggacaagcacgctgagggtccagagatgggccggcccgcaagggaggcgtgctcaggtgctgcatggctgtcgtcagctcgtgccgtgaggtgttgggttaagtcccgcaacgagcgcaaccctcgctctcggttggaagtctccgaggggactgccgcgcacaacgcggaggaaggtggggatgacgtcaagtcagcatggccctgacatcctgggcgacacacacgctacaatggtcgggacagcgggcagcgacccggcgacggggagccaatcccttaaacccgatctcagtgcagattgcaggctgcaacccgcctgcatgaaggaggagttgctagtaaccgccggtcagcacacggcggtgaatacgttctcgggtcttgtacacaccgcccgtcacaccacgaaagccggcaacacctgaagccgctgggcgaacccctcg

SEQ ID NO: 9755 - DNA, 1526 bp, Thermomicrobium roseum
  ref <308>: DATABASE ACCESSION NUMBER: NCBI ACCESSION: NC_011959.1
  ref <309>: DATABASE ENTRY DATE: 2019-04-01
  ref <313>: RELEVANT RESIDUES IN SEQ ID NO: (1)..(1526)
ggggatggagagtttgatcctggctcagggggaacgctggcggcgtgcctaatgcatgcaagtcggacgggagcacgctctggcgtgccgaccgtggcggacgggtgcgtaacacgtggggaacctgcccgggtgcgggggataacccggggaaactcgggctaataccccatacgcttggctggcggtgggccggccaaggaaaggcgcaggcgactgtgctgtgctcggagggccctgcggcctatcagctagacggtagggtaacggcctaccgtggcgatgacgggtagctggtctgagaggatggccagccacacgggcactgagacacgggcccgactcctacgggaggcagcagcagggaatcttccgcaatgggggcaaccctgacggagcgacgccgcgtgcgggaggaagcccttcggggtgtaaaccgctgttcggggggacgatcgagcgacggtaccctcggagcaagtcccggctaactacgtgccagcagccgcggtaagacgtagggggcgagcgttacccggagtcactgggcgtaaagggcgtgtaggcggctgggtacgccgcgtgtgaaagtccccggctcaaccggggagggtcgcgcgggacggcctggctcgagggcgggagaggcgggtggaattcccggtgtagcggtgaaatgcgtagagatcgggaggaacgccggtggcgaaggcggcccgctggcccgtacctgacgctgaggcgcgaaggcgtggggagcgaaccggattagatacccgggtagtccacgcagtaaacgatgcgggcgaggtgtgggtggtgttgaccccatccgtgccggcgccaacgcagtaagcccgccgcctggggagtacggccgcaaggctaaaactcaaaggaattgacgggggcccgcacaagcagcggagcgtgtggtttaattcgacgcaacgcgaagaaccttaccagggcttgacatgccaccgaacctggctgaaaggctggggtgcccggtgagggagcggtggcacaggtgctgcatggctgtcgtcagctcgtgccgtgaggtgttgggttaagtcccgcaacgagcgcaaccctcggggtcagttacgcgggtgtctgacccgactgccggggaaagcccggaggaaggaggggatgacgtcaagtcagcatggccctgacgccctgggcgacacacacgctacagtgaccgggacagtgggcagcgaaggggcgacctggagccaatcccgcaaacccggtcgtggtggggatcgcaggctgcaacccgcctgcgtgaacgcggagttgctagtaaccgccggtcagccatacggcggtgaatacgttcccgggccttgtacacaccgcccgtcacgtcacgaaagctggcttcacctgaagccggtgggccaaccggcgcacgctgggggcagccgtcgagggtggggctggtgattgggacgaagtcgtaacaaggtagccgtaccggaaggtgcggctggatcacctcctttcta

SEQ ID NO: 9756 - DNA, 234 bp, Thermonema rossianum
  ref <308>: DATABASE ACCESSION NUMBER: NCBI ACCESSION: NZ_AUGC01000010.1
  ref <309>: DATABASE ENTRY DATE: 2019-04-01
  ref <313>: RELEVANT RESIDUES IN SEQ ID NO: (1)..(234)
tttttacaacggagagtttgatcctggctcaggatgaacgctagcggcaggcctaatacatgcaagtcgaggggcagcgggtcttccttcgggaagatgccggcgaccggcgcacgggtgcgtaacgcgtatgcaacctgccctgcactgggggatagctcagggaaacttgaggtaataccccatatgctcatcgaggggcatcccttgttgaggaaagctccggcggtgcag

SEQ ID NO: 9757 - DNA, 1522 bp, Thermopetrobacter sp. TC1
  ref <308>: DATABASE ACCESSION NUMBER: NCBI ACCESSION: NZ_KN050828.1
  ref <309>: DATABASE ENTRY DATE: 2019-04-01
  ref <313>: RELEVANT RESIDUES IN SEQ ID NO: (1)..(1522)
tcaaacttgagagtttgatcctggctcagaacgaacgctggcggcaggcctaacacatgcaagtcgaacggcagcaggcctctcctcggagaggtgctggcgagtggcaaacgggtgagtaacgcgtgggaacctgccctgcagtggggaataaccacgggaaaccgtggctaataccgcatacgcccttcgggggaaaggcccttgtggccgctgcaggaggggcccgcgtccgattagctagttggtgaggtaacggctcaccaaggcgacgatcggtagctggtctgagaggatgatcagccacactgggactgagacacggcccagactcctacgggaggcagcagtggggaatattggacaatgggcgaaagcctgatccagccatgccgcgtgggtgaagaaggccttagggttgtaaagccctttcagcggggaagataatgacggtacccgcagaagaagccccggctaactccgtgccagcagccgcggtaatacggagggggctagcgttgttcggaattactgggcgtaaagcgcacgtaggcggatcgttaagtcaggggtgaaagcccggagctcaactccggaactgcccttgatactggcgatctcgaggccgggagaggtgagcggaattcccagtgtagaggtgaaattcgtagatattgggaggaacaccagtggcgaaggcggctcactggcccggttctgacgctgaggtgcgaaagcgtggggagcaaacaggattagataccctggtagtccacgccgtaaacgatggatgctagccgtcgggcagcttgctgttcggtggcgcagctaacgcgttaagcatcccgcctggggagtacggtcgcaagactaaaactcaaaggaattgacgggggcccgcacaagcggtggagcatgtggtttaattcgaagcaacgcgcagaaccttacctgggcttgacatcccgtgccaccccggagagatctggggatatcggcttcggccgacacggtgacaggtgctgcatggctgtcgtcagctcgtgtcgtgagatgttgggttaagtcccgcaacgagcgcaaccctcgcctctagttgccagcggttcggccgggcactctagagggaccgccagcgataagctggaggaaggtggggatgacgtcaagtcctcatggcccttacgcccagggctacacacgtgctacaatggcggcgacagagggcagccactccgcgaggaggagctaatcccgaaacgccgtcccagttcggattgcactctgcaactcgagtgcatgaagccggaatcgctagtaatcgcggatcagcatgccgcggtgaatacgttcccgggccttgtacacaccgcccgtcacaccatgggagttggctctacccgaagacggtgcgctaacccgcaagggaggcagccggccacggtagggtcagcgactggggtgaagtcgtaacaaggtagccgtaggggaacctgcggctggatcacctcctttctaagga

SEQ ID NO: 9758 - DNA, 1525 bp, Thermorudis peleae
  ref <308>: DATABASE ACCESSION NUMBER: NCBI ACCESSION: NZ_JQMP01000003.1
  ref <309>: DATABASE ENTRY DATE: 2019-04-01
  ref <313>: RELEVANT RESIDUES IN SEQ ID NO: (1)..(1525)
tggtggagagtttgatcctggctcagggacaacgctggcggcgtgcctaatgcatgcaagtcggacgggagccgcggaagcggtcgaccgtggcggacgggtgcggaacacgtggggaacctgccctggcgtgggggacaaccctgggaaactggggctaatcccgcatacgctcctctggtggtaggctaggggaggaaaggccggatggtcgcgctgggagggccctgcggcctatcagctagacggtgtggtaacggcgcaccgtggcgatgacgggtcgctggtctgagaggacggccagccacacggggactgggacacggccccgactcctacgggaggcagcagcagggaatcttccgcaatgggggcaaccctgacggagcgacgccgcgtggaggacgacgccctgcggggtgtaaactcctgttcggggggacgaaggcagtgacggtaccctcggagcaagccccggctaactccgtgccagcagccgcggtaagacggagggggcgagcgttgcccggagtcactgggcgtaaagggcgcgtaggcggctgggcgcgccgcgcgtgaaagcccccggctcaaccggggagggtcgcgcgggacggtctggctcgagggcgggagaggcgggtggaattcccggtgtagcggtgaaatgcgtagagctcgggaggaacaccggtggcgaaggcggcccgctggcccgtacctgacgctgaggcgcgaaggcgtggggagcgaaccggattagatacccgggtagtccacgcagtcaacgatgcgggcgaggtgtggggcgtgttgacccgctctgtgccggcgctcacgcagtaagcccgccgcctggggagtacggccgcaaggctaaaactcaaaggaattgacgggggcccgcacaagcagcggagcgtgtggtttaattcgacgcaacgcgcagaaccttaccagggcttgacatggcctcggacctggcggaaacgctggggtgccctgcttgcagggagcgaggtcacaggtgctgcatggctgtcgtcagctcgtgccgtgaggtgttgggttaagtcccgcaacgagcgcaaccctcggggccagttacgcgggtgtctggcccgactgccgggcgcaacccggaggaaggaggggatgacgtcaagtccgcatggccctgacgccctgggcgacacacacgctacagtggccgggacaatgggcggccaaggggcgacctggagccaatcccgcaaacccggccgtggtggggatcgcaggctgcaacccgcctgcgtgaacgcggagttgctagtaaccgccggtcagccatacggcggtgaatacgttcccgggccttgtacacaccgcccgtcacgtcacgaaagccggctccacctgaagccggtgggctaacccacggaagtggggggcagccgtcgagggtggggcgggtgattgggacgaagtcgtaacaaggtagccgtaccggaaggtgcggctggatcacctcctttctagggag

SEQ ID NO: 9759 - DNA, 1522 bp, Thermosediminibacter oceani
  ref <308>: DATABASE ACCESSION NUMBER: NCBI ACCESSION: NC_014377.1
  ref <309>: DATABASE ENTRY DATE: 2019-04-01
  ref <313>: RELEVANT RESIDUES IN SEQ ID NO: (1)..(1522)
gagagtttgatcctggctcaggacgaacgctggcggcgtgcctaacacatgcaagtcgagcggggtaaattgagtggttttccacgagatttacccagcggcggacgggtgagtaacacgtaggcaacctacccaccacacggggatagccctgggaaaccgggggtaatacccgatacctttactggctgcatggctggtaaagaaagcgatttagcggtggtggatgggcctgcggcccatcagctagttggcggggtaacggcccaccaaggcgacgacgggtagccggcctgagagggtggacggccacactgggactgggacacggcccagactcctacgggaggcagcagtggggaatcttgggcaatgggggaaaccctgacccagcgacgccgcgtggaggaagaaggccttcgggttgtaaactcctgtcaccggggacgaagaggacggtacccggggaggaagccccggctaactacgtgccagcagccgcggtaatacgtagggggcgagcgttgtccggaatcactgggcgtaaagggcgtgtaggcgggtctgcaagttgcgggtaaaaagccagggctcaaccctggaggtgcctgcaaaactgcggatcttgagggcgggagaggagagtggaattcccggagtagcggtgaaatgcgtagataccgggaggaacaccagtggcgaaggcggctctctggaccgaccctgacgctgaggcgcgaaagctaggggagcgaacgggattagataccccggtagtcctagccgtaaacgatggtcactaggtgtgggcagttgtcaagctgtccgtgccggagctaacgcaataagtgacccgcctggggagtacggccgcaaggttgaaactcaaaggaattgacgggggcccgcacaagcggtggagcatgtggtttaattcgaagcaacgcgaagaaccttaccaggccttgacatgcaggtagtagcgaaccgaaaggggagcgacccgagggaaaccgagggagcctgcacaggtggtgcatggttgtcgtcagctcgtgtcgtgagatgttgggttaagtcccgcaacgagcgcaacccctacctctagttgccagcgggtaaagccgggcactctagaggaactgccgccgacaaggcggaggaaggtggggatgacgtcaaatcatcatgccctttatggcctgggccacacacgtgctacaatggccggtacagcgggaagcgaaggcgcgagctggagcgaatccctaaaaaccggtctcagttcagattgcaggctgcaactcgcctgcatgaaggcggaatcgctagtaatcgcggatcagcatgccgcggtgaatacgttcccgggccttgtacacaccgcccgtcacaccatgggagttggcaacacccgaagccggcataagatgccgtcgaaggtggggccagcgactggggtgaagtcgtaacaaggtagccgtaccggaaggtgcggctggatcacctcctttctaaggag

SEQ ID NO: 9760 - DNA, 1678 bp, Thermosinus carboxydivorans
  ref <308>: DATABASE ACCESSION NUMBER: NCBI ACCESSION: NZ_AAWL01000016.1
  ref <309>: DATABASE ENTRY DATE: 2019-04-01
  ref <313>: RELEVANT RESIDUES IN SEQ ID NO: (1)..(1678)
tttattggagagtttgatcctggctcaggacgaacgctggcggcgtgcctaacacatgcaagtcgaacggactgatgttcaacaccgagcattttagggtgttggagacgacggcagcgcataagctgcgaagcagctttacgcgttaaaaaaagtgccaacacaacactttagagtcatcggtgttgaacatcagttagtggcgaacgggtgagtaacgcgtagacaacctaccttctagatggggataacaccgcgaaagtggtgctaataccgaatgtgtcaacctaggcgcatgcctaggttgagaaaggtggcctctggaaacaagctaccgctagaagatgggtctgcgtctgattagctagttggtagggtaacggcctaccaaggcgacgatcagtagccggtctgagaggatggacggtcacactgggactgagacacggcccagactcctacgggaggcagcagtggggaatcttccgcaatgggcgaaagcctgacggagcaacgccgcgtgggtgaagaaggccttcgggtcgtaaagccctgtcaatcgggacgaagtttacttatgcgaatagtgtaagtaagtgacggtaccggaggaggaagccacggctaactacgtgccagcagccgcggtaatacgtaggtggcaagcgttgtccggaattattgggcgtaaagcgcgcgtaggcggggcgtcaagtccatcttaaaaggcctgggctcaaccctggtatgggatggaaactgacgttcttgagtgcaggagaggaaagtggaattcccggtgtagcggtgaaatgcgtagatatcgggaggaacaccagtggcgaaggcggctttctggactgtgtctgacgctgaggcgcgaaagccaggggagcgaacgggattagataccccggtagtcctggccgtaaacgatgggtactaggtgtgggaggtaaccaatccttctgtgccggagttaacgcaataagtaccccgcctggggagtacggccgcaaggctgaaactcaaaggaattgacgggggcccgcacaagcggtggagtatgtggtttaattcgacgcaacgcgaagaaccttaccagggcttgacatcgagggaagcggctagagatagtcgcgtcttgccttagggcaagacccgaagacaggtggtgcatggctgtcgtcagctcgtgtcgtgagatgttgggttaagtcccgcaacgagcgcaacccttatcccttgttgccagcacgttatggtggggactcaagggagactgccgcagacaatgcggaggaaggtggggatgacgtcaagtcatcatgccccttatgtcctgggctacacacgtactacaatgggcttaaatagagggcatgcgaagccgcgaggcagagcgaaccccaaaaacaagctctcagttcggatcgcaggctgcaactcgcctgcgtgaagtcggaatcgctagtaatcgcagatcagcatgctgcggtgaatacgttcccgggccttgtacacaccgcccgtcacaccacgagagtcgagagcacccgaagccggtggggtaaccgcaaggagccagccgtcgaaggtgagatcgatgattggggtgaagtcgtaacaaggtagccgtatcggaaggtgcggctggatcacctcctttctagggaga

SEQ ID NO: 9761 - DNA, 1577 bp, Thermosipho globiformans
  ref <308>: DATABASE ACCESSION NUMBER: NCBI ACCESSION: NZ_BHXD01000034.1
  ref <309>: DATABASE ENTRY DATE: 2019-04-01
  ref <313>: RELEVANT RESIDUES IN SEQ ID NO: (1)..(1577)
attcatggagggtttgatcctggctcagggtgaacgctggcggcgtgccttacacatgcaagtcgagcgaagctgctggtggaattccttcggggaggaagccagtagactgagcggcggacgggtgagtaacgcgtaggtgacctacccctcagagggggataactgggggaaactccagctaataccccatacgttcctacctataagtaggtaggaagaaagggagctatagctctgctgagggaggggcctgcgacccatcaggtagttggtgaggtaacggctcaccaagccgacgacgggtagccggtctgagaggatggccggccacaagggcactgagacacgggccctactcctacgggaggcagcagtgggggattttggacaatgggcgaaagcctgatccagcgacgccgcgtgcgggacgaagcccttcggggtgtaaaccgctgtggtgggagacgaataaggtgaggagtggaaagcctcactgatgacggtatcccactagaaagccccggctaactacgtgccagcagccgcggtaatacgtagggggcgagcgttacccggatttactgggcgtaaagggggcgtaggcggccgtgaaagtccggtgtgaaaactcacggctcaaccgtgggactgcgctggaaactacacggcttgaggacggtagagggagacggaactgctggtgtaggggtgaaatccgtagatatcagcaggaacgccggtggagaagtcggtctcctgggccgttcctgacgctgaggcccgaaagctaggggagcaaaccggattagatacccgggtagtcctagccgtaaacgatgcccactaggtgtgggggagtaattcctccgtgctgaagctaacgcgataagtgggccgcctggggagtatgcccgcaagggtgaaactcaaaggaattgacgggaccccgcacaagcggtggagcgtgtggtttaattggacgctaagccaagaaccttaccagggcttgacatgctggtggtactgacccgaaaggggagggacctgtggcgtaagtcacgggagccagcacaggtggtgcacggtcgtcgtcagctcgtgccgtgaggtgttgggttaagtcccgcaacgagcgcaacccctgcccttagttgccagcggttcggccgggcactctaaggggactgccggcgacgagccggaggaaggaggggatgacgtcagatactcgtgccccttatgccctgggcgacacacgcgctacaatgggtgggacagcgggaagcgagccagcgatggtgagcgaaacccttaaacccaccctcagttcggattgcaggctgaaacccgcctgcatgaagccggaatcgctagtaatcgcggatcagccacgccgcggtgaatacgttcccggggtttgtacacaccgcccgtcacgccacccgagttggcagcgcccgaagatgggtactccaaccgaaagggggaggcctattgagggcgaggctggcgaggggggcgaagtcgtaacaaggtaggtgtaccggaaggtgcgcctggatcacctcctttct

SEQ ID NO: 9762 - DNA, 724 bp, Thermosporothrix hazakensis
  ref <308>: DATABASE ACCESSION NUMBER: NCBI ACCESSION: NZ_QKUF01000088.1
  ref <309>: DATABASE ENTRY DATE: 2019-04-01
  ref <313>: RELEVANT RESIDUES IN SEQ ID NO: (1)..(724)
cagcgccctggagagtacctgacgctcagatgcgaaagctaggggagcgaacgggattagataccccggtagtcctagccgtaaacgatgaccactagatgtccggagtatcgacccttcgggtatcggagctaacgcgttaagtggtccgcctggggagtacggtcgcaagattaaaactcaaaggaattgacggggacccgcacaagcagcggagcgtgtggtttaattcgatgcaacgcgaagaaccttaccaggtcttgacatcacactgacagctctagagatagggtcttccttcgggacagtgtgacaggtgctgcatggctgtcgtcagctcgtgtcgtgagatgttgggttaagtcccgcaacgagcgcaaccctcgtcgctagttgaatgttctagcgagaccgccgttacaaagcggaggaaggtggggatgacgtcaagtcagcacggcccttacgacctgggcgacacacacgctacaatggccgggacaaagggcagccaacccgcgagggggagccaatcccatcaaacccggtctcagttcagattgcaggctgcaacccgcctgcatgaagtcggagttgctagtaaccgtaggtcagcacactacggtgaatacgttcccgggtcttgtacacaccgcccgtcacaccacgaaagtcggcaacacctgaagccgctgggctaacctcgttgaggaggcaggcgtcg

SEQ ID NO: 9763 - DNA, 1590 bp, Thermosulfidibacter takaii
  ref <308>: DATABASE ACCESSION NUMBER: NCBI ACCESSION: NZ_AP013035.1
  ref <309>: DATABASE ENTRY DATE: 2019-04-01
  ref <313>: RELEVANT RESIDUES IN SEQ ID NO: (1)..(1590)
tttgcacggagggtttgatcctggctcagcgcgaacgctagcggcgcgcctaacacatgcaagtcgtggggcagcaggccgaatccttcgggattcggtgctggcgaccggcggacgggtgagtaacgcgtgagtaacctacccctaggaccgggataaccctccgaaaggggggctaataccggataagctcacggtgcgcatgtactgtgagaaaagggggcctctgcttagcatgctcccgcctagggatgggctcgcgtcccatcagctagttggtggggtaacggcccaccaaggctatgacgggtagccggcctgagagggtggtcggccacacgggcactgagacacgggcccgactcctacgggaggcagcagtggggaatattgggcaatgggcgcaagcctgacccagcgacgccgcgtgggggatgaaggcctttgggtcgtaaacccctgtcaggagggaagaacggctcggtggtgaataatcaccgggtctgacggtacctccagaggaagggacggctaactacgtgccagcagccgcggtaatacgtaggtcccgagcgttgcgcggaatcactgggcgtaaagagtgcgtaggcggcctggtaagtcggaggttaaagcccacggctcaaccgtggaactgcctccgatactgctgggcttgaggccgggagaggccggcggaattcccggtgtagcggtgaaatgcgtagatatcgggaggaacaccggaggcgaaggcggccggctggcccgcgcctgacgctgaggcacgaaagcgtggggagcaaaccggattagatacccgggtagtccacgccgtaaaccatgggtgctaggtgtggggagggacaacctctccgtgccgaagctaacgcgttaagcaccccgcctggggagtacggccgcaaggctgaaactcaaaggaattgacggggacccgcacaagcggcggagcatgtggtttaatccgacgctacgcgtagaaccttaccagggcttgacatgctggcataagcccgcccgaaagggttgggtgggtatggccttgtgccataccggccagcacaggtgttgcatggctgtcgtcagctcgtgccgtgaggtgttcggttaagtccggcaacgagcgcaacccctgcccctagttgccagcggttcggccgggcactctagggggactgccggcgataagccggaggaaggtggggatgacgtcaagtcatcatggcccttatgccctgggctacacacgtgctacaatggccgggacagagggttgcgaagccgcgaggcggagccaatcccaaaaacccggtcccagttcggattgcaggctgcaactcgcctgcatgaagccggagtcgctagtaatcgcggatcagctacgccgcggtgaatacgttcccgggtcttgtacacaccgcccgtcacaccacgaaagtcgggtgtaccggaagccggtaaccccaacccggcaacgggagggggccgaccaaggtatgcccggcgattggggtgaagtcgtaacaaggtagccctagcggaagctggggctggatcacctcctttcta

SEQ ID NO: 9764 - DNA, 1576 bp, Thermosulfurimonas dismutans
  ref <308>: DATABASE ACCESSION NUMBER: NCBI ACCESSION: NZ_LWLG01000001.1
  ref <309>: DATABASE ENTRY DATE: 2019-04-01
  ref <313>: RELEVANT RESIDUES IN SEQ ID NO: (1)..(1576)
ctgagggtttgatcctggctcagggcgaacgctggcggcgtgcctaacacatgcaagtcgtgggggaaagggaggcttcggcctcccgagtacaccggcagacgggtgagtaacacgtgggtaacctgcccccgggtccgggataacctctcgaaaggggggctaataccggataaagtgcgtgggcgcaagctcacgcaccaaagggggcctctgcatagcaagctcctgcctggggaggggcccgcggcccatcagctagttggtggggtaacggcccaccaaggctacgacgggtagccggcctgagagggtggtcggccacacgggcactgagacacgggcccgactcctacgggaggcagcagtggggaatcttgggcaatgggcgcaagcctgacccagcgacgccgcgtgggggaagaaggccttcgggtcgtaaacccctgtcaggggggaagaaccctgctccggtgaataaccggatgcaggctgacggtacccccagaggaagccacggctaactccgtgccagcagccgcggtaatacggaggtggcaagcgttgcccggaatcactgggcgtaaagggggcgtaggcggccaggcaagtcggaggttaaagcccggggctcaaccccggaaaggcctccgatactgcttggcttgaggaccggagaggctggcggaattcccggtgtaggggtgaaatccgtagatatcgggaggaacaccagtggggaagccggccagctggacggttcctgacgctgaggcccgaaagcgtggggagcaaaccggattagatacccgggtagtccacgccgtaaacgatgggcgctgggtgtggggggttaatccctccgtgccgtagctaacgcgttaagcgccccgcctggggagtacggccgcaaggctgaaactcaaaggaattgacgggggcccgcacaagcggtggagcacgtggtttaattcgatgcaaagcgaagaaccttacccgggcttgacatgctagggtcgtacccggcagagatgtcggggaggtcagactttgtctgaccgctctagcacaggtgctgcatggctgtcgtcagctcgtgtcgtgagatgttgggttaagtcccgcaacgagcgcaaccctcgcccctagttgccagcggttcggccgggcactctagggggactgccggggacaacccggaggaaggaggggatgacgtcaagtcctcatggcccttatgcccggggctacacacgtgctacaatgggcggtacagagggttgcgaacccgcaagggggagctaatcccagaaagccgccctcagttcggatcggggtctgcaactcgaccccgtgaagccggaatcgctagtaacggcggatcagcatgccgccgtgaatacgttcccgggccttgtacacaccgcccgtcacaccacggaagccggctctgcccgaagtcgctgtcccaaccccgtaaggggagggaggcgcctacggcagggctggtgactggggtgaagtcgtaacaaggtatccctaccggaaggtggggatggatcacctcctttctaag

SEQ ID NO: 9765 - DNA, 1491 bp, Thermosynechococcus elongatus
  ref <308>: DATABASE ACCESSION NUMBER: NCBI ACCESSION: NC_004113.1
  ref <309>: DATABASE ENTRY DATE: 2019-04-01
  ref <313>: RELEVANT RESIDUES IN SEQ ID NO: (1)..(1491)
aaaatggagagtttgatcctggctcaggatgaacgctggcggtctgcttaacacatgcaagtcgaacgagcacttcggtgctagtggcggacgggtgagtaacacgtgagaatctaccctcaggagggggataacggctggaaacggccgctaataccccatatgccgcaaggtgaaatcttttttggcctggggatgagctcgcggtggattagctagttggtggggtaatggcctaccaaggcgacgatccatagctggtctgagaggatgatcagccacactgggactgagacacggcccagactcctacgggaggcagcagtggggaattttccgcaatgggcgaaagcctgacggagcaagaccgcgtgagggatgaaggcctttgggttgtaaacctcttttctcagggaagaacacaatgacggtacctgaggaataagcctcggctaactccgtgccagcagccgcggtaagacggaggaggcaagcgttatccggaattattgggcgtaaagcgtccgcaggtggctttccaagtctgccgtcaaagcccgaggcttaacctcggatcggcggtggaaactggatcgctagagtgcgtcaggggtagggggaattcccggtgtagcggtgaaatgcgtagatatcgggaagaacaccagtgacgaaagtgccctactgggacgttactgacactcatggacgaaagctaggggagcgaaagggattagatacccctgtagtcctagccgtaaacgatggacactaggtgttgctggtatccactccagcagtgccgtagccaacgcgttaagtgtcccgcctggggagtacgcacgcaagtgtgaaactcaaaggaattgacgggggcccgcacaagcggtggagtatgtggtttaattcgatgcaacgcgaagaaccttaccagggcttgacatgtcgcgaatcccgcggaaacgtgggagtgccttcgggaacgcgaacacaggtggtgcatggctgtcgtcagctcgtgtcgtgagatgttgggttaagtcccgcaacgagcgcaaccctcgtccttagttgccagcattcagttgggcactctagggagactgccggtgacaaaccggaggaaggtggggatgacgtcaagtcatcatgccccttacgtcctgggctacacacgtactacaatgctgtggacaaagagttgccaacccgcgagggcgagctaatctcttaaaccacggctcagttcagattgcaggctgcaactcgcctgcatgaaggcggaatcgctagtaatcgcaggtcagcatactgcggtgaatacgttcccgggccttgtacacaccgcccgtcacaccatgggagttggccatgcccgaagtcgttactctaacccgcaagggagggggacgcctaaggcagggctgatgactggggtgaagtcgtaacaaggtagccgtaccggaaggtgtggctggatcacctcctttt

SEQ ID NO: 9766 - DNA, 1498 bp, Thermosynechococcus sp. NK55a
  ref <308>: DATABASE ACCESSION NUMBER: NCBI ACCESSION: NC_023033.1
  ref <309>: DATABASE ENTRY DATE: 2019-04-01
  ref <313>: RELEVANT RESIDUES IN SEQ ID NO: (1)..(1498)
tcaaaatggagagtttgatcctggctcaggatgaacgctggcggtctgcttaacacatgcaagtcgaacgagcacttcggtgctagtggcggacgggtgagtaacacgtgagaatctaccctcaggagggggataacggctggaaacggccgctaataccccatatgccgcaaggtgaaatcttttttggcctgaggatgagctcgcggtggattagctagttggtggggtaatggcctaccaaggcgacgatccatagctggtctgagaggatgatcagccacactgggactgagacacggcccagactcctacgggaggcagcagtggggaattttccgcaatgggcgaaagcctgacggagcaagaccgcgtgagggatgaaggcctttgggttgtaaacctcttttctcagggaagaacacaatgacggtacctgaggaataagcctcggctaactccgtgccagcagccgcggtaagacggaggaggcaagcgttatccggaattattgggcgtaaagcgtccgcaggtggctttccaagtctgccgtcaaagcccgaggcttaacctcggatcggcggtggaaactggatcgctagagtgcgtcaggggtagggggaattcccggtgtagcggtgaaatgcgtagatatcgggaagaacaccagtgacgaaagtgccctactgggacgttactgacactcatggacgaaagctaggggagcgaaagggattagatacccctgtagtcctagccgtaaacgatggacactaggtgttgctggtatccactccagcagtgccgtagccaacgcgttaagtgtcccgcctggggagtacgcacgcaagtgtgaaactcaaaggaattgacgggggcccgcacaagcggtggagtatgtggtttaattcgatgcaacgcgaagaaccttaccagggcttgacatgtcgcgaatcccgcggaaacgtgggagtgccttcgggaacgcgaacacaggtggtgcatggctgtcgtcagctcgtgtcgtgagatgttgggttaagtcccgcaacgagcgcaaccctcgtccttagttgccagcattcagttgggcactctagggagactgccggtgacaaaccggaggaaggtggggatgacgtcaagtcatcatgccccttacgtcctgggctacacacgtactacaatgctgtggacaaagagttgccaacccgcgagggcgagctaatctcttaaaccacggcccagttcagattgcaggctgcaactcgcctgcatgaaggcggaatcgctagtaatcgcaggtcagcatactgcggtgaatacgttcccgggccttgtacacaccgcccgtcacaccatgggagttggccatgcccgaagtcgttactctaacccgcaagggagggggacgcctaaggcagggctgatgactggggtgaagtcgtaacaaggtagccgtaccggaaggtgtggctggatcacctccttttaagga

SEQ ID NO: 9767 - DNA, 1497 bp, Thermosynechococcus vulcanus
  ref <308>: DATABASE ACCESSION NUMBER: NCBI ACCESSION: NZ_AP018202.1
  ref <309>: DATABASE ENTRY DATE: 2019-04-01
  ref <313>: RELEVANT RESIDUES IN SEQ ID NO: (1)..(1497)
tcaaaatggagagtttgatcctggctcaggatgaacgctggcggtctgcttaacacatgcaagtcgaacgagcacttcggtgctagtggcggacgggtgagtaacacgtgagaatctaccctcaggagggggataacggctggaaacggccgctaataccccatatgccgcaaggtgaaatcttttttggcctggggatgagctcgcggtggattagctagttggtggggtaatggcctaccaaggcgacgatccatagctggtctgagaggatgatcagccacactgggactgagacacggcccagactcctacgggaggcagcagtggggaattttccgcaatgggcgaaagcctgacggagcaagaccgcgtgagggatgaaggcctttgggttgtaaacctcttttctcagggaagaacacaatgacggtacctgaggaataagcctcggctaactccgtgccagcagccgcggtaagacggaggaggcaagcgttatccggaattattgggcgtaaagcgtccgcaggtggctttccaagtctgccgtcaaagcccgaggcttaacctcggatcggcggtggaaactggatcgctagagtgcgtcaggggtagggggaattcccggtgtagcggtgaaatgcgtagatatcgggaagaacaccagtgacgaaagtgccctactgggacgttactgacactcatggacgaaagctaggggagcgaaagggattagatacccctgtagtcctagccgtaaacgatggacactaggtgttgctggtatccactccagcagtgccgtagccaacgcgttaagtgtcccgcctggggagtacgcacgcaagtgtgaaactcaaaggaattgacgggggcccgcacaagcggtggagtatgtggtttaattcgatgcaacgcgaagaaccttaccagggcttgacatgtcgcgaatcccgcggaaacgtgggagtgccttcgggaacgcgaacacaggtggtgcatggctgtcgtcagctcgtgtcgtgagatgttgggttaagtcccgcaacgagcgcaaccctcgtccttagttgccagcattcagttgggcactctagggagactgccggtgacaaaccggaggaaggtggggatgacgtcaagtcatcatgccccttacgtcctgggctacacacgtactacaatgctgtggacaaagagttgccaacccgcgagggcgagctaatctcttaaaccacggctcagttcagattgcaggctgcaactcgcctgcatgaaggcggaatcgctagtaatcgcaggtcagcatactgcggtgaatacgttcccgggccttgtacacaccgcccgtcacaccatgggagttggccatgcccgaagtcgttactctaacccgcaagggagggggacgcctaaggcagggctgatgactggggtgaagtcgtaacaaggtagccgtaccggaaggtgtggctggatcacctccttttaagg

SEQ ID NO: 9768 - DNA, 1372 bp, Thermosyntropha lipolytica
  ref <308>: DATABASE ACCESSION NUMBER: NCBI ACCESSION: NZ_FQWY01000001.1
  ref <309>: DATABASE ENTRY DATE: 2019-04-01
  ref <313>: RELEVANT RESIDUES IN SEQ ID NO: (1)..(1372)
acagtaaagatggcctataggggctatcgcttatggatgggctcgcgtctgattagctagttggtggggtaacggcctaccaaggcgacgatcagtagccggcctgagagggtggacggccacactgggactgagacacggcccagactcctacgggaggcagcagtggggaatattgcgcaatgggggaaaccctgacgcagcgacgccgcgtgagcgaagaaggcctttgggtcgtaaagctctgttgtaagggacgaaggacacgctgcgaaaagtggcgtgaggtgacggtaccttacgaggaagccccggctaactacgtgccagcagccgcggtaagacgtagggggcgagcgttgtccggaattactgggcgtaaagagcacgtaggcgggtgaataagtcaggtgtgaaagaccggagctcaacttcggggttgcatctgatactgttcatcttgagggcaggagagggcagtagaattcctggtgtagcggtgaaatgcgtagaaatcaggaggaataccggtggcgaaggcggctgcctggactggccctgacgctgaggtgcgaaagcgtggggagcaaacaggattagataccctggtagtccacgctgtaaacgatggatactaggtgtgggggggtagacccttccgtgccggagcaaacgcaataagtatcccgcctggggagtacggtcgcaaggctgaaactcaaaggaattgacgggggcccgcacaagcggtggagcatgtggtttaattcgatgcaacgcgaagaaccttaccaggccttgacatccagcgaacctggtggaaacactggggtgcctgtcgaaaggcaggagcgctgagacaggtggtgcatggttgtcgtcagctcgtgtcgtgagatgttgggttaagtcccgcaacgagcgcaacccttgccattagttgctaacaggtgaagctgagcactctaatgggactgcccgtgacaagcgggaggaaggtggggatgacgtcaaatcatcatgccctttatggtctgggctacacacgtgctacaatgggtggtacagagagaggcgaagccgcgaggtggagcgaatctcaaaaagccactctcagttcggattgcagtctgcaactcgactgcatgaagtcggaatcgctagtaatcgcgaatcagcatgtcgcggtgaatgcgttcccgggccttgtacacaccgcccgtcacaccacgaaagtcggcaacacccgaagtcggtgagctaaccgcggaagcggaggcaaccgccgaaggtggggtcggtgattggggtgaagtcgtaacaaggtatccgtaccggaaggtgcggatggatcacctcctttctaaggaga

SEQ ID NO: 9769 - DNA, 1552 bp, Thermotoga caldifontis
  ref <308>: DATABASE ACCESSION NUMBER: NCBI ACCESSION: NZ_AP014509.1
  ref <309>: DATABASE ENTRY DATE: 2019-04-01
  ref <313>: RELEVANT RESIDUES IN SEQ ID NO: (1)..(1552)
tggagggtttgatcctggctcagggtgaacgctggcggcgtgcctaacacatgcaagtcgagcgggtacccgcaagggtaccagcggcgcacgggtgagtaacacgtgggtaatctacccctcggagggggataaccgggggaaaccccggctaataccccatacgatccaatgacgacggtcattggatgaaaggggcgtttcgcctcgccgagggatgagcccgcggcccatcaggtagttggtggggtaatggcccaccaagcctacgacgggtagctggcctgagagggtggtcggccacaagggcactgagacacgggccctactcctacgggaggcagcagtggggaatcttggacaatgggcgaaagcctgatccagcgacgccgcgtgggggacgaagcccttcggggtgtaaacccctgttgcgagggaggaataagacctggaggaaatgccaggtcgatgactgtacctcgcgagaaagccccggctaactacgtgccagcagccgcggtaatacgtagggggcgagcgttacccggattcactgggcgtaaagggggtgtaggcggctcggtaagtcgggtgtgaaatcccacggctcaaccgtggaattgcgcccgaaactgccgagcttggggccggtagagggagacggaactgccggtgtaggggtgaaatccgtagatatcggcaggaacgccggtggggaagccggtctcctgggccgcgcccgacgctgaggcccgaaagctaggggagcaaaccggattagatacccgggtagtcctagccgtaaacgatgcccactaggtgtgggggagtatttcctccgtgctgtagctaacgcgttaagtgggccgcctggggagtacgcccgcaagggtgaaactcaaaggaattggcgggaccccgcacaagcggtggagcgcgtggtttaattggatgctgagccaagaaccttaccagggcttgacatgcaggtggtaccgacccgaaaggggagggaccccatccttttgggtggggagcctgcacaggtggtgcacggccgtcgtcagctcgtgccgtgaggtgttgggttaagtcccgcaacgagcgcaacccctgcccttagttgccatcggttcggccgggcactctaaggggactgccggcgacgagccggaggaaggaggggacgacgtcaggtactcgtgccctttatgccctgggctacacacgcgctacaatgggtggtacagtgggttgcgaccccgcgagggggagccaatccctaaaaccacccccagttcggatcgcaggctgcaacccgcctgcgtgaagccggaatcgctagtaatcgcggatcagccacgccgcggtgaatacgttcccggggtttgcacacaccgcccgtcaagccacccgagccgggggcacccgaagacgcccatcctaacccgaaagggagggagggcgttgagggtgaatctggtgaggggggctaagtcgtaacaaggtagccgtactggaaggtgcggctggatcacctcctttctaggga

SEQ ID NO: 9770 - DNA, 1564 bp, Thermotoga maritima
  ref <308>: DATABASE ACCESSION NUMBER: NCBI ACCESSION: NZ_CP011108.1
  ref <309>: DATABASE ENTRY DATE: 2019-04-01
  ref <313>: RELEVANT RESIDUES IN SEQ ID NO: (1)..(1564)
ttatatggagggtttgatcctggctcagggtgaacgctggcggcgtgcctaacacatgcaagtcgagcgggggaaactcccttcggggaggagtacccagcggcggacgggtgagtaacacgtgggtaacctgccctccggagggggataaccaggggaaaccctggctaataccccatacgctccatcaacgcaagttggtggaggaaaggggcgtttgccccgccggaggaggggcccgcggcccatcaggtagttggtggggtaacggcccaccaagccgacgacgggtagccggcctgagagggtggtcggccacaggggcactgagacacgggccccactcctacgggaggcagcagtggggaatcttggacaatgggggaaaccctgatccagcgacgccgcgtgcgggacgaagcccttcggggtgtaaaccgctgtggcgggggaagaataaggtagggaggaaatgccctaccgatgacggtaccccgctagaaagccccggctaactacgtgccagcagccgcggtaatacgtagggggcaagcgttacccggatttactgggcgtaaagggggcgtaggcggcctggtgtgtcggatgtgaaatcccacggctcaaccgtggggctgcatccgaaactaccaggcttgggggcggtagagggagacggaactgccggtgtaggggtgaaatccgtagatatcggcaggaacgccggtggggaagccggtctcctgggccgaccccgacgctgaggcccgaaagccaggggagcaaaccggattagatacccgggtagtcctggctgtaaacgatgcccactaggtgtgggggggtaatccctccgtgctgaagctaacgcgttaagtgggccgcctggggagtacgcccgcaagggtgaaactcaaaggaattgacgggggcccgcacaagcggtggagcgtgtggtttaattggatgctaagccaagaaccttaccagggcttgacatgccggtggtacctccccgaaaggggtagggacccagtccttcgggactgggagccggcacaggtggtgcacggccgtcgtcagctcgtgccgtgaggtgttgggttaagtcccgcaacgagcgcaacccctgcccctagttgccagcggttcggccgggcactctagggggactgccggcgacgagccggaggaaggaggggatgacgtcaggtactcgtgccccttatgccctgggcgacacacgcgctacaatgggcggtacaatgggttgcgaccccgcgagggggagccaatccccaaagccgccctcagttcggatcgcaggctgcaacccgcctgcgtgaagccggaatcgctagtaatcgcggatcagccatgccgcggtgaatacgttcccgggccttgtacacaccgcccgtcaagccacccgagtcgggggctcccgaagacacctaccccaacccgaaagggagggggggtgtcgagggagaacctggcgaggggggcgaagtcgtaacaaggtagccgtaccggaaggtgcggctggatcacctcctttcta

SEQ ID NO: 9771 - DNA, 1564 bp, Thermotoga naphthophila
  ref <308>: DATABASE ACCESSION NUMBER: NCBI ACCESSION: NC_013642.1
  ref <309>: DATABASE ENTRY DATE: 2019-04-01
  ref <313>: RELEVANT RESIDUES IN SEQ ID NO: (1)..(1564)
ttatatggagggtttgatcctggctcagggtgaacgctggcggcgtgcctaacacatgcaagtcgagcgggggaaactcccttcggggaggagtactcagcggcggacgggtgagtaacacgtgggtaacctgccctccggagggggataaccaggggaaaccctggctaataccccatacgctccatcaacgcaagttggtggaggaaaggggcgtttgccccgccggaggaggggcccgcggcccatcaggtagttggtggggtaacggcccaccaagccgacgacgggtagccggcctgagagggtggtcggccacaggggcactgagacacgggccccactcctacgggaggcagcagtggggaatcttggacaatgggggaaaccctgatccagcgacgccgcgtgcgggacgaagcccttcggggtgtaaaccgctgtggcgggggaagaataaggtagggaggaaatgccctaccgatgacggtaccccgctagaaagccccggctaactacgtgccagcagccgcggtaatacgtagggggcaagcgttacccggatttactgggcgtaaagggggcgtaggtggcctggtgtgtcggatgtgaaatcccacggctcaaccgtgggactgcatccgaaactaccaggcttgggggcggtagagggagacggaactgccggtgtaggggtgaaatccgtagatatcggcaggaacgccggtggggaagccggtctcctgggccgaccccgacgctgaggcccgaaagccaggggagcaaaccggattagatacccgggtagtcctggccgtaaacgatgcccactaggtgtggggggattatccctccgtgctgaagctaacgcgttaagtgggccgcctggggagtacgcccgcaagggtgaaactcaaaggaattgacgggggcccgcacaagcggtggagcgtgtggtttaattggatgctaagccaagaaccttaccagggcttgacatgccggtggtacctccccgaaaggggtagggacccagtcctttgggactgggagccggcacaggtggtgcacggccgtcgtcagctcgtgccgtgaggtgttgggttaagtcccgcaacgagcgcaacccctgcccctagttgccagcggttcggccgggcactctagggggactgccggcgacgagccggaggaaggaggggatgacgtcaggtactcgtgccccttatgccctgggcgacacacgcgctacaatgggcggtacaatgggttgcgaccccgcgagggggagccaatccccaaaaccgccctcagttcggatcgcaggctgcaacccgcctgcgtgaagccggaatcgctagtaatcgcggatcagccacgccgcggtgaatacgttcccgggccttgtacacaccgcccgtcacgccacccgagtcgggggctcccgaagacacctgccccaacccgaaagggagggggggtgttgagggagaacctggtgaggggggcgaagtcgtaacaaggtagccgtaccggaaggtgcggctggatcacctcctttcta

SEQ ID NO: 9772 - DNA, 1563 bp, Thermotoga neapolitana
  ref <308>: DATABASE ACCESSION NUMBER: NCBI ACCESSION: NZ_ASGQ01000004.1
  ref <309>: DATABASE ENTRY DATE: 2019-04-01
  ref <313>: RELEVANT RESIDUES IN SEQ ID NO: (1)..(1563)
ttatatggagggtttgatcctggctcagggtgaacgctggcggcgtgcctaacacatgcaagtcgagcgggggaaactcccctttggggaggagtacccagcggcggacgggtgagtaacacgtgggtaacctgccctccggagggggataaccaggggaaaccctggctaataccccatacgctccatcaacgcaagttggtggaggaaaggggcgtttgccccgccggaggaggggcccgcggcccatcaggtagttggtggggtaacggcccaccaagccgacgacgggtagccggcctgagagggtggtcggccacaggggcactgagacacgggccccactcctacgggaggcagcagtggggaatcttggacaatgggggaaaccctgatccagcgacgccgcgtgcgggacgaagccttcggggtgtaaaccgctgtggcgggggaagaataaggcagggaggaaatgccctgccgatgacggtaccccgctagaaagccccggctaactacgtgccagcagccgcggtaatacgtagggggcaagcgttacccggatttactgggcgtaaagggggcgtaggcggcctggtgtgtcggatgtgaaatcccacggctcaaccgtggggctgcatccgaaactaccaggcttgggggcggtagagggagacggaactgccggtgtaggggtgaaatccgtagatatcggcaggaacgccggtggggaagccggtctcctgggccgaccccgacgctgaggcccgaaagccaggggagcaaaccggattagatacccgggtagtcctggctgtaaacgatgcccactaggtgtggggggataatccctccgtgctgaagctaacgcgttaagtgggccgcctggggagtacgcccgcaagggtgaaactcaaaggaattgacgggggcccgcacaagcggtggagcgtgtggtttaattggatgctaagccaagaaccttaccagggcttgacatgccggtggtacctcccgaaaggggtagggacccagtccttcgggactgggagccggcacaggtggtgcacggccgtcgtcagctcgtgccgtgaggtgttgggttaagtcccgcaacgagcgcaacccctgcccctagttgccagcggttcggccgggcactctagggggactgccggcgacgagccggaggaaggaggggatgacgtcaggtactcgtgccccttatgccctgggcgacacacgcgctacaatgggcggtacaatgggttgcgaccccgcgagggggagccaatccccaaagccgccctcagttcggatcgcaggctgcaacccgcctgcgtgaagccggaatcgctagtaatcgcggatcagccatgccgcggtgaatacgttcccgggccttgtacacaccgcccgtcacgccacccgagtcgggggctcccgaagacacctgccccaacccgaaagggagggggggtgtcgagggagaacctggcgaggggggcgaagtcgtaacaaggtagccgtaccggaaggtgcggctggatcacctcctttcta

SEQ ID NO: 9773 - DNA, 1564 bp, Thermotoga petrophila
  ref <308>: DATABASE ACCESSION NUMBER: NCBI ACCESSION: NC_009486.1
  ref <309>: DATABASE ENTRY DATE: 2019-04-01
  ref <313>: RELEVANT RESIDUES IN SEQ ID NO: (1)..(1564)
ttatatggagggtttgatcctggctcagggtgaacgctggcggcgtgcctaacacatgcaagtcgagcgggggaaactcccttcggggaggagtacccagcggcggacgggtgagtaacacgtgggtaacctgccctccggagggggataaccaggggaaaccctggctaataccccatacgctccatcaacgcaagttggtggaggaaaggggcgtttgccccgccggaggaggggcccgcggcccatcaggtagttggtggggtaacggcccaccaagccgacgacgggtagccggcctgagagggtggtcggccacaggggcactgagacacgggccccactcctacgggaggcagcagtggggaatcttggacaatgggggaaaccctgatccagcgacgccgcgtgcgggacgaagcccttcggggtgtaaaccgctgtggcgggggaagaataaggtagggagggaatgccctaccgatgacggtaccccgctagaaagccccggctaactacgtgccagcagccgcggtaatacgtagggggcaagcgttacccggatttactgggcgtaaagggggcgtaggcggcctggtgtgtcggatgtgaaatcccacggctcaaccgtggggccgcatccgaaactaccaggcttgggggcggtagagggagacggaactgccggtgtaggggtgaaatccgtagatatcggcaggaacgccggtggggaagccggtctcctgggccgaccccgacgctgaggcccgaaagccaggggagcaaaccggattagatacccgggtagtcctggccgtaaacgatgcccactaggtgtgggggggtcatccctccgtgctgaagctaacgcgttaagtgggccgcctggggagtacgcccgcaagggtgaaactcaaaggaattgacgggggcccgcacaagcggtggagcgtgtggtttaattggatgctaagccaagaaccttaccagggcttgacatgccggtggtacctccccgaaaggggtagggacccagtcctttgggactgggagccggcacaggtggtgcacggccgtcgtcagctcgtgccgtgaggtgttgggttaagtcccgcaacgagcgcaacccctgcccctagttgccagcggttcggccgggcactctagggggactgccggcgacgagccggaggaaggaggggatgacgtcaggtactcgtgccccttatgccctgggcgacacacgcgctacaatgggcggtacaatgggttgcgaccccgcgagggggagccaatccccaaaaccgccctcagttcggatcgcaggctgcaacccgcctgcgtgaagccggaatcgctagtaatcgcggatcagccacgccgcggtgaatacgttcccgggccttgtacacaccgcccgtcacgccacccgagtcgggggctcccgaagacacctgccccaacccgaaagggagggggggtgttgagggagaacctggtgaggggggcgaagtcgtaacaaggtagccgtaccggaaggtgcggctggatcacctcctttcta

SEQ ID NO: 9774 - DNA, 1551 bp, Thermotoga profunda
  ref <308>: DATABASE ACCESSION NUMBER: NCBI ACCESSION: NZ_AP014510.1
  ref <309>: DATABASE ENTRY DATE: 2019-04-01
  ref <313>: RELEVANT RESIDUES IN SEQ ID NO: (1)..(1551)
tggagggtttgatcttggctcagggtgaacgctggcggcgtgcttaacacatgcaagtcgagcgggtatccgcaaggataccagcggcgcacgggtgagtaatacgtaggtaacctacccctcagaggggaataactgggggaaactccagctaatgccccatataatccaatggcgacggccgttggatgaaaggagcgtttgcttcgctgagggatgggcctgcgtcccatcaggtagttggtgaggtaatggctcaccaagcctacgacgggtagccgacctgagagggtggccggccacaagggcactgagacacgggccctactcctacgggaggcagcagtggggaattttggacaatgggcgaaagcctgatccagcgacgccgcgtgggggacgaagcccttcggggtgtaaacccctgttgtgagggacgaataagatctggaggaaatgccaggtcgatgacggtacctcacgagaaagccccggctaactacgtgccagcagccgcggtaatacgtagggggcgagcgttacccggattcactgggcgtaaagggggcgtaggcgacttagtgtgtcgggtgtgaaatcccacggctcaaccgtggaattgcgcccgaaactactgagtttggggccggtagagggagatggaactgctggtgtaggggtgaaatccgtagatatcagcaggaacgccggtggggaagccggtctcctgggccgtgcccgacgctgaggcccgaaagctaggggagcaaaccggattagatacccgggtagtcctagccgtaaacgatgctcactaggtgtgggggagtcattcctccgtgctgcagttaacgcgttaagtgagccgcctggggagtacgcccgcaagggtgaaactcaaaggaattggcgggaccccgcacaagcggtggagcgtgtggtttaattggatgctaagccaagaaccttaccagggcttgacatgcaggtggtaccaacccgaaagggaagggaccctttccttttggaaagggagcttgcacaggtggtgcacggccgtcgtcagctcgtgccgtgaggtgttgggttaagtcccgcaacgagcgcaacccctgcccttagttgccagcggttcggccgggcactctaaggggactgccggcgacgagccggaggaaggaggggacgacgtcaggtactcgtgccctttatgccctgggctacacacgcgctacaatgggtggtacaatgggttgctactccgcgaggagaagctaatccctaaaaccatccccagttcagatcgcaggctgcaacccgcctgcgtgaagccggaatcgctagtaatcgcggatcagccacgccgcggtgaatacgttcccggggtttgcacacaccgcccgtcaagccacccgagtcgggggcacctgaagacgcttatcctaacccgaaagggagggaaggcgttgaaggtgaatctggtgaggggggctaagtcgtaacaaggtagccgtactggaaggtgcggctggatcacctcctttctaggga

SEQ ID NO: 9775 - DNA, 1564 bp, Thermotoga sp. 2812B
  ref <308>: DATABASE ACCESSION NUMBER: NCBI ACCESSION: NZ_CP003408.1
  ref <309>: DATABASE ENTRY DATE: 2019-04-01
  ref <313>: RELEVANT RESIDUES IN SEQ ID NO: (1)..(1564)
ttatatggagggtttgatcctggctcagggtgaacgctggcggcgtgcctaacacatgcaagtcgagcgggggaaactcccttcggggaggagtacccagcggcggacgggtgagtaacacgtgggtaacctgccctccggagggggataaccaggggaaaccctggctaataccccatacgctccatcaacgcaagttggtggaggaaaggggcgtttgccccgccggaggaggggcccgcggcccatcaggtagttggtggggtaacggcccaccaagccgacgacgggtagccggcctgagagggtggtcggccacaggggcactgagacacgggccccactcctacgggaggcagcagtggggaatcttggacaatgggggaaaccctgatccagcgacgccgcgtgcgggacgaagcccttcggggtgtaaaccgctgtggcgggggaagaataaggtagggaggaaatgccctaccgatgacggtaccccgctagaaagccccggctaactacgtgccagcagccgcggtaatacgtagggggcaagcgttacccggatttactgggcgtaaagggggcgtaggcggcctggtgtgtcggatgtgaaatcccacggctcaaccgtggggctgcatccgaaactaccaggcttgggggcggtagagggagacggaactgccggtgtaggggtgaaatccgtagatatcggcaggaacgccggtggggaagccggtctcctgggccgaccccgacgctgaggcccgaaagccaggggagcaaaccggattagatacccgggtagtcctggctgtaaacgatgcccactaggtgtgggggggtaatccctccgtgctgaagctaacgcgttaagtgggccgcctggggagtacgcccgcaagggtgaaactcaaaggaattgacgggggcccgcacaagcggtggagcgtgtggtttaattggatgctaagccaagaaccttaccagggcttgacatgccggtggtacctccccgaaaggggtagggacccagtccttcgggactgggagccggcacaggtggtgcacggccgtcgtcagctcgtgccgtgaggtgttgggttaagtcccgcaacgagcgcaacccctgcccctagttgccagcggttcggccgggcactctagggggactgccggcgacgagccggaggaaggaggggatgacgtcaggtactcgtgccccttatgccctgggcgacacacgcgctacaatgggcggtacaatgggttgcgaccccgcgagggggagccaatccccaaagccgccctcagttcggatcgcaggctgcaacccgcctgcgtgaagccggaatcgctagtaatcgcggatcagccatgccgcggtgaatacgttcccgggccttgtacacaccgcccgtcacgccacccgagtcgggggctcccgaagacacctaccccaacccgaaagggagggggggtgtcgagggagaacctggcgaggggggcgaagtcgtaacaaggtagccgtaccggaaggtgcggctggatcacctcctttcta

SEQ ID NO: 9776 - DNA, 1563 bp, Thermotoga sp. Cell2
  ref <308>: DATABASE ACCESSION NUMBER: NCBI ACCESSION: NZ_CP003409.1
  ref <309>: DATABASE ENTRY DATE: 2019-04-01
  ref <313>: RELEVANT RESIDUES IN SEQ ID NO: (1)..(1563)
tatatggagggtttgatcctggctcagggtgaacgctggcggcgtgcctaacacatgcaagtcgagcgggggaaactcccttcggggaggagtacccagcggcggacgggtgagtaacacgtgggtaacctgccctccggagggggataaccaggggaaaccctggctaataccccatacgctccatcaacgcaagttggtggaggaaaggggcgcttgccccgccggaggaggggcccgcggcccatcaggtagttggtggggtaacggcccaccaagccgacgacgggtagccggcctgagagggtggtcggccacaggggcactgagacacgggccccactcctacgggaggcagcagtggggaatcttggacaatgggggaaaccctgatccagcgacgccgcgtgcgggacgaagcccttcggggtgtaaaccgctgtggcgggggaagaataaggtagggaggaaatgccctaccgatgacggtaccccgctagaaagccccggctaactacgtgccagcagccgcggtaatacgtagggggcaagcgttacccggatttactgggcgtaaagggggcgtaggcggcctggtgtgtcggatgtgaaatcccacggctcaaccgtggggctgcatccgaaactaccaggcttgggggcggtagagggagacggaactgccggtgtaggggtgaaatccgtagatatcggcaggaacgccggtggggaagccggtctcctgggccgaccccgacgctgaggcccgaaagccaggggagcaaaccggattagatacccgggtagtcctggctgtaaacgatgcccactaggtgtgggggggtaatccctccgtgctgaagctaacgcgttaagtgggccgcctggggagtacgcccgcaagggtgaaactcaaaggaattgacgggggcccgcacaagcggtggagcgtgtggtttaattggatgctaagccaagaaccttaccagggcttgacatgccggtggtacctccccgaaaggggtagggacccagtccttcgggactgggagccggcacaggtggtgcacggccgtcgtcagctcgtgccgtgaggtgttgggttaagtcccgcaacgagcgcaacccctgcccctagttgccagcggttcggccgggcactctagggggactgccggcgacgagccggaggaaggaggggatgacgtcaggtactcgtgccccttatgccctgggcgacacacgcgctacaatgggcggtacaatgggttgcgaccccgcgagggggagccaatccccaaagccgccctcagttcggatcgcaggctgcaacccgcctgcgtgaagccggaatcgctagtaatcgcggatcagccacgccgcggtgaatacgttcccgggccttgtacacaccgcccgtcacgccacccgagtcgggggctcccgaagacacctaccccaacccgaaagggagggggggtgtcgagggagaacctggcgaggggggcgaagtcgtaacaaggtagccgtaccggaaggtgcggctggatcacctcctttcta

SEQ ID NO: 9777 - DNA, 1564 bp, Thermotoga sp. EMP; identical to SEQ ID NO: 9775
  ref <308>: DATABASE ACCESSION NUMBER: NCBI ACCESSION: NZ_AJII01000007.1
  ref <309>: DATABASE ENTRY DATE: 2019-04-01
  ref <313>: RELEVANT RESIDUES IN SEQ ID NO: (1)..(1564)

SEQ ID NO: 9778 - DNA, 1565 bp, Thermotoga sp. KOL6
  ref <308>: DATABASE ACCESSION NUMBER: NCBI ACCESSION: NZ_LNDE01000003.1
  ref <309>: DATABASE ENTRY DATE: 2019-04-01
  ref <313>: RELEVANT RESIDUES IN SEQ ID NO: (1)..(1565)
tatatggagggtttgatcctggctcagggtgaacgctggcggcgtgcctaacacatgcaagtcgagcggaggaaactcccctttggggaggagtactcagcggcggacgggtgagtaacacgtgggtaacctatcctccggagggggataaccaggggaaaccctggctaataccccatacgctccgtccacgtaagtgggcggaggaaaggagcgtttgctccgccggaggaggggcccgcggcccatcaggtagttggtggggtaacggcccaccaagcctacgacgggtagccggcctgagagggtggtcggccacaggggcactgagacacgggccccactcctacgggaggcagcagtggggaatcttggacaatgggggaaaccctgatccagcgacgccgcgtgcgggacgaagcccttcggggtgtaaaccgctgtggcgggggacgaataaggcagggaggaaatgccctgccgatgacggtaccccgctagaaagccccggctaactacgtgccagcagccgcggtaatacgtagggggcgagcgttacccggatttactgggcgtaaagggggcgtaggcggcctggtgtgtcggatgtgaaatcccacggctcaaccgtggggctgcatccgaaactaccaggcttgggggcggtagagggagacggaactgccggtgtaggggtgaaatccgtagatatcggcaggaacgccggtggggaagccggtctcctgggccgaccccgacgctgaggcccgaaagccaggggagcaaaccggattagatacccgggtagtcctggctgtaaacgatgcccactaggtgtgggggggtcactccctccgtgctgaagctaacgcgttaagtgggccgcctggggagtacgcccgcaagggtgaaactcaaaggaattgacgggggcccgcacaagcggtggagcgtgtggtttaattggatgctaagccaagaaccttaccagggcttgacatgccggtggtacctccccgaaaggggtagggacccagtccttcgggactgggagccggcacaggtggtgcacggccgtcgtcagctcgtgccgtgaggtgttgggttaagtcccgcaacgagcgcaacccctgcccctagttgccagcggttcggccgggcactctagggggactgccggcgacgagccggaggaaggaggggatgacgtcaggtactcgtgccccttatgccctgggcgacacacgcgctacaatgggcggtacaatgggttgcgaccccgcgagggggagccaatccccaaagccgccctcagttcggatcgcaggctgcaacccgcctgcgtgaagccggaatcgctagtaatcgcggatcagccatgccgcggtgaatacgttcccgggccttgtacacaccgcccgtcacgccacccgagtcgggggctcccgaagacacctgccccaacccgaaagggagggggggtgtcgagggagaacctggcgaggggggcgaagtcgtaacaaggtagccgtaccggaaggtgcggctggatcacctcctttcta

SEQ ID NO: 9779 - DNA, 1563 bp, Thermotoga sp. Mc24
  ref <308>: DATABASE ACCESSION NUMBER: NCBI ACCESSION: NZ_JSFH01000004.1
  ref <309>: DATABASE ENTRY DATE: 2019-04-01
  ref <313>: RELEVANT RESIDUES IN SEQ ID NO: (1)..(1563)
ttatatggagggtttgatcctggctcagggtgaacgctggcggcgtgcctaacacatgcaagtcgagcgggggaaactcccttcggggaggagtacccagcggcggacgggtgagtaacacgtgggtaacctaccctccggagggggataaccaggggaaaccctggctaataccccatacgctccatcaacgcaagttggtggaggaaaggggcgtttgccccgccggaggaggggcccgcggcccatcaggtagttggtggggtaatggcccaccaagccgacgacgggtagccggcctgagagggtggtcggccacaggggcactgagacacggaccccactcctacgggaggcagcagtggggaatcttggacaatgggggaaaccctgatccagcgacgccgcgtgcgggacgaagcccttcggggtgtaaaccgctgtggcgggggaagaataaggtagggaggaaatgccctaccgatgacggtaccccgctagaaagccccggctaactacgtgccagcagccgcggtaatacgtagggggcaagcgttacccggatttactgggcgtaaagggggcgtaggcggcctggtgtgtcggatgtgaaatcccacggctcaaccgtggggccgcatccgaaactactgggcttgggggcggtagagggagacggaactgccggtgtaggggtgaaatccgtagatatcggcaggaacgccggtggggaagccggtctcctgggccgaccccgacgctgaggcccgaaagccaggggagcaaaccggattagatacccgggtagtcctggccgtaaacgatgcccactaggtgtgggggggtatccctccgtgctgaagccaacgcgttaagtgggccgcctggggagtacgcccgcaagggtgaaactcaaaggaattgacgggggcccgcacaagcggtggagcgtgtggtttaattggatgctaagccaagaaccttaccagggcttgacatgccggtggtacctccccgaaaggggtagggacccagtcctttgggactgggagccggcacaggtggtgcacggccgtcgtcagctcgtgccgtgaggtgttgggttaagtcccgcaacgagcgcaacccctgcccctagttgccagcggttcggccgggcactctagggggactgccggcgacgagccggaggaaggaggggatgacgtcaggtactcgtgccccttatgccctgggcgacacacgcgctacaatgggcggtacaatgggttgcgaccccgcgagggggagccaatccccaaaaccgccctcagttcggatcgcaggctgcaacccgcctgcgtgaagccggaatcgctagtaatcgcggatcagccacgccgcggtgaatacgttcccgggccttgtacacaccgcccgtcacgccacccgagtcgggggctcccgaagacacctgccccaacccgaaagggagggggggtgttgagggagaacctggtgaggggggcgaagtcgtaacaaggtagccgtaccggaaggtgcggctggatcacctcctttcta

SEQ ID NO: 9780 - DNA, 1565 bp, Thermotoga sp. RQ2
  ref <308>: DATABASE ACCESSION NUMBER: NCBI ACCESSION: NC_010483.1
  ref <309>: DATABASE ENTRY DATE: 2019-04-01
  ref <313>: RELEVANT RESIDUES IN SEQ ID NO: (1)..(1565)
ttatatggagggtttgatcctggctcagggtgaacgctggcggcgtgcctaacacatgcaagtcgagcgggggaaactcccttcggggaggagtacccagcggcggacgggtgagtaacacgtgggtaacctgccctccggagggggataaccaggggaaaccctggctaataccccatacgctccatcaacgcaagttggtggaggaaaggggcgcttgccccgccggaggaggggcccgcggcccatcaggtagttggtggggtaacggcccaccaagccgacgacgggtagccggcctgagagggtggtcggccacaggggcactgagacacgggccccactcctacgggaggcagcagtggggaatcttggacaatgggggaaaccctgatccagcgacgccgcgtgcgggacgaagcccttcggggtgtaaaccgctgtggcgggggaagaataaggtagggaggaaatgccctaccgatgacggtaccccgctagaaagccccggctaactacgtgccagcagccgcggtaatacgtagggggcaagcgttacccggatttactgggcgtaaagggggcgtaggcggcctggtgtgtcggatgtgaaatcccacggctcaaccgtggggctgcatccgaaactaccaggcttgggggcggtagagggagacggaactgccggtgtaggggtgaaatccgtagatatcggcaggaacgccggtggggaagccggtctcctgggccgaccccgacgctgaggcccgaaagccaggggagcaaaccggattagatacccgggtagtcctggctgtaaacgatgcccactaggtgtggggggggtaatccctccgtgctgaagctaacgcgttaagtgggccgcctggggagtacgcccgcaagggtgaaactcaaaggaattgacgggggcccgcacaagcggtggagcgtgtggtttaattggatgctaagccaagaaccttaccagggcttgacatgccggtggtacctccccgaaaggggtagggacccagtccttcgggactgggagccggcacaggtggtgcacggccgtcgtcagctcgtgccgtgaggtgttgggttaagtcccgcaacgagcgcaacccctgcccctagttgccagcggttcggccgggcactctagggggactgccggcgacgagccggaggaaggaggggatgacgtcaggtactcgtgccccttatgccctgggcgacacacgcgctacaatgggcggtacaatgggttgcgaccccgcgagggggagccaatccccaaagccgccctcagttcggatcgcaggctgcaacccgcctgcgtgaagccggaatcgctagtaatcgcggatcagccatgccgcggtgaatacgttcccgggccttgtacacaccgcccgtcacgccacccgagtcgggggctcccgaagacacctaccccaacccgaaagggagggggggtgtcgagggagaacctggcgaggggggcgaagtcgtaacaaggtagccgtaccggaaggtgcggctggatcacctcctttcta

SEQ ID NO: 9781 - DNA, 1565 bp, Thermotoga sp. RQ7
  ref <308>: DATABASE ACCESSION NUMBER: NCBI ACCESSION: NZ_CP007633.1
  ref <309>: DATABASE ENTRY DATE: 2019-04-01
  ref <313>: RELEVANT RESIDUES IN SEQ ID NO: (1)..(1565)
ttatatggagggtttgatcctggctcagggtgaacgctggcggcgtgcctaacacatgcaagtcgagcgggggaaactcccctttggggaggagtacccagcggcggacgggtgagtaacacgtgggtaacctgccctccggagggggataaccaggggaaaccctggctaataccccatacgctccatcaacgcaagttggtggaggaaaggggcgtttgccccgccggaggaggggcccgcggcccatcaggtagttggtggggtaacggcccaccaagccgacgacgggtagccggcctgagagggtggtcggccacaggggcactgagacacgggccccactcctacgggaggcagcagtggggaatcttggacaatgggggaaaccctgatccagcgacgccgcgtgcgggacgaagcccttcggggtgtaaaccgctgtggcgggggaagaataaggcagggaggaaatgccctgccgatgacggtaccccgctagaaagccccggctaactacgtgccagcagccgcggtaatacgtagggggcaagcgttacccggatttactgggcgtaaagggggcgtaggcggcctggtgtgtcggatgtgaaatcccacggctcaaccgtggggctgcatccgaaactaccaggcttgggggcggtagagggagacggaactgccggtgtaggggtgaaatccgtagatatcggcaggaacgccggtggggaagccggtctcctgggccgaccccgacgctgaggcccgaaagccaggggagcaaaccggattagatacccgggtagtcctggctgtaaacgatgcccactaggtgtgggggggtaatccctccgtgctgaagctaacgcgttaagtgggccgcctggggagtacgcccgcaagggtgaaactcaaaggaattgacgggggcccgcacaagcggtggagcgtgtggtttaattggatgctaagccaagaaccttaccagggcttgacatgccggtggtacctccccgaaaggggtagggacccagtccttcgggactgggagccggcacaggtggtgcacggccgtcgtcagctcgtgccgtgaggtgttgggttaagtcccgcaacgagcgcaacccctgcccctagttgccagcggttcggccgggcactctagggggactgccggcgacgagccggaggaaggaggggatgacgtcaggtactcgtgccccttatgccctgggcgacacacgcgctacaatgggcggtacaatgggttgcgaccccgcgagggggagccaatccccaaagccgccctcagttcggatcgcaggctgcaacccgcctgcgtgaagccggaatcgctagtaatcgcggatcagccatgccgcggtgaatacgttcccgggccttgtacacaccgcccgtcacgccacccgagtcgggggctcccgaagacacctgccccaacccgaaagggagggggggtgtcgagggagaacctggcgaggggggcgaagtcgtaacaaggtagccgtaccggaaggtgcggctggatcacctcctttcta

SEQ ID NO: 9782 - DNA, 1564 bp, Thermotoga sp. SG1
  ref <308>: DATABASE ACCESSION NUMBER: NCBI ACCESSION: NZ_LNDD01000001.1
  ref <309>: DATABASE ENTRY DATE: 2019-04-01
  ref <313>: RELEVANT RESIDUES IN SEQ ID NO: (1)..(1564)
tatatggagggtttgatcctggctcagggtgaacgctggcggcgtgcctaacacatgcaagtcgagcgggggaaactcccctttggggaggagtacccagcggcggacgggtgagtaacacgtgggtaacctgccctccggagggggataaccaggggaaaccctggctaataccccatacgctccatcaacgcaagttggtggaggaaaggggcgtttgccccgccggaggaggggcccgcggcccatcaggtagttggtggggtaacggcccaccaagccgacgacgggtagccggcctgagagggtggtcggccacaggggcactgagacacgggccccactcctacgggaggcagcagtggggaatcttggacaatgggggaaaccctgatccagcgacgccgcgtgcgggacgaagcccttcggggtgtaaaccgctgtggcgggggaagaataaggcagggaggaaatgccctgccgatgacggtaccccgctagaaagccccggctaactacgtgccagcagccgcggtaatacgtagggggcgagcgttacccggatttactgggcgtaaagggggcgtaggcggcctggtgtgtcggatgtgaaatcccacggctcaaccgtggggctgcatccgaaactaccaggcttgggggcggtagagggagacggaactgccggtgtaggggtgaaatccgtagatatcggcaggaacgccggtggggaagccggtctcctgggccgaccccgacgctgaggcccgaaagccaggggagcaaaccggattagatacccgggtagtcctggctgtaaacgatgcccactaggtgtggggggataatccctccgtgctgaagctaacgcgttaagtgggccgcctggggagtacgcccgcaagggtgaaactcaaaggaattgacgggggcccgcacaagcggtggagcgtgtggtttaattggatgctaagccaagaaccttaccagggcttgacatgccggtggtacctccccgaaaggggtagggacccagtccttcgggactgggagccggcacaggtggtgcacggccgtcgtcagctcgtgccgtgaggtgttgggttaagtcccgcaacgagcgcaacccctgcccctagttgccagcggttcggccgggcactctagggggaccgccggcgacgagccggaggaaggaggggatgacgtcaggtactcgtgccccttatgccctgggcgacacacgcgctacaatgggcggtacaatgggttgcgaccccgcgagggggagccaatccccaaagccgccctcagttcggatcgcaggctgcaacccgcctgcgtgaagccggaatcgctagtaatcgcggatcagccatgccgcggtgaatacgttcccgggccttgtacacaccgcccgtcacgccacccgagtcgggggctcccgaagacacctgccccaacccgaaagggagggggggtgtcgagggagaacctggcgaggggggcgaagtcgtaacaaggtagccgtaccggaaggtgcggctggatcacctcctttcta

SEQ ID NO: 9783 - DNA, 1564 bp, Thermotoga sp. TBGT1765
  ref <308>: DATABASE ACCESSION NUMBER: NCBI ACCESSION: NZ_JSFG01000015.1
  ref <309>: DATABASE ENTRY DATE: 2019-04-01
  ref <313>: RELEVANT RESIDUES IN SEQ ID NO: (1)..(1564)
ttatatggagggtttgatcctggctcagggtgaacgctggcggcgtgcctaacacatgcaagtcgagcgggggaaactcccttcggggaggagtacccagcggcggacgggtgagtaacacgtgggtaacctgccctccggagggggataaccaggggaaaccctggctaataccccatacgctccatcaacgcaagttggtggaggaaaggggcgcttgccccgccggaggaggggcccgcggcccatcaggtagttggtggggtaacggcccaccaagccgacgacgggtagccggcctgagagggtggtcggccacaggggcactgagacacgggccccactcctacgggaggcagcagtggggaatcttggacaatgggggaaaccctgatccagcgacgccgcgtgcgggacgaagcccttcggggtgtaaaccgctgtggcgggggaagaataaggtagggaggaaatgccctaccgatgacggtaccccgctagaaagccccggctaactacgtgccagcagccgcggtaatacgtagggggcaagcgttacccggatttactgggcgtaaagggggcgtaggcggcctggtgtgtcggatgtgaaatcccacggctcaaccgtggggctgcatccgaaactaccaggcttgggggcggtagagggagacggaactgccggtgtaggggtgaaatccgtagatatcggcaggaacgccggtggggaagccggtctcctgggccgaccccgacgctgaggcccgaaagccaggggagcaaaccggattagatacccgggtagtcctggctgtaaacgatgcccactaggtgtgggggggtaatccctccgtgctgaagctaacgcgttaagtgggccgcctggggagtacgcccgcaagggtgaaactcaaaggaattgacgggggcccgcacaagcggtggagcgtgtggtttaattggatgctaagccaagaaccttaccagggcttgacatgccggtggtacctccccgaaaggggtagggacccagtccttcgggactgggagccggcacaggtggtgcacggccgtcgtcagctcgtgccgtgaggtgttgggttaagtcccgcaacgagcgcaacccctgcccctagttgccagcggttcggccgggcactctagggggactgccggcgacgagccggaggaaggaggggatgacgtcaggtactcgtgccccttatgccctgggcgacacacgcgctacaatgggcggtacaatgggttgcgaccccgcgagggggagccaatccccaaagccgccctcagttcggatcgcaggctgcaacccgcctgcgtgaagccggaatcgctagtaatcgcggatcagccacaccgcggtgaatacgttcccgggccttgtacacaccgcccgtcacgccacccgagtcgggggctcccgaagacacctaccccaacccgaaagggagggggggtgtcgagggagaacctggcgaggggggcgaagtcgtaacaaggtagccgtaccggaaggtgcggctggatcacctcctttcta

SEQ ID NO: 9784 - DNA, 1564 bp, Thermotoga sp. TBGT1766; identical to SEQ ID NO: 9783
  ref <308>: DATABASE ACCESSION NUMBER: NCBI ACCESSION: NZ_JSFI01000014.1
  ref <309>: DATABASE ENTRY DATE: 2019-04-01
  ref <313>: RELEVANT RESIDUES IN SEQ ID NO: (1)..(1564)

SEQ ID NO: 9785 - DNA, 1564 bp, Thermotoga sp. Xyl54
  ref <308>: DATABASE ACCESSION NUMBER: NCBI ACCESSION: NZ_JSFJ01000009.1
  ref <309>: DATABASE ENTRY DATE: 2019-04-01
  ref <313>: RELEVANT RESIDUES IN SEQ ID NO: (1)..(1564)
ttatatggagggtttgatcctggctcagggtgaacgctggcggcgtgcctaacacatgcaagtcgagcgggggaaactcccttcggggaggagtacccagcggcggacgggtgagtaacacgtgggtaacctgccctccggagggggataaccaggggaaaccctggctaataccccatacgctccatcaacgcaagttggtggaggaaaggggcgcttgccccgccggaggaggggcccgcggcccatcaggtagttggtggggtaacggcccaccaagccgacgacgggtagccggcctgagagggtggtcggccacaggggcactgagacacgggccccactcctacgggaggcagcagtggggaatcttggacaatgggggaaaccctgatccagcgacgccgcgtgcgggacgaagcccttcggggtgtaaaccgctgtggcgggggaagaataaggtagggaggaaatgccctaccgatgacggtaccccgctagaaagccccggctaactacgtgccagcagccgcggtaatacgtagggggcaagcgttacccggatttactgggcgtaaagggggcgtaggcggcctggtgtgtcggatgtgaaatcccacggctcaaccgtggggctgcatccgaaactaccaggcttgggggcggtagagggagacggaactgccggtgtaggggtgaaatccgtagatatcggcaggaacgccggtggggaagccggtctcctgggccgaccccgacgctgaggcccgaaagccaggggagcaaaccggattagatacccgggtagtcctggctgtaaacgatgcccactaggtgtgggggggtaatccctccgtgctgaagctaacgcgttaagtgggccgcctggggagtacgcccgcaagggtgaaactcaaaggaattgacgggggcccgcacaagcggtggagcgtgtggtttaattggatgctaagccaagaaccttaccagggcttgacatgccggtggtacctccccgaaaggggtagggacccagtccttcgggactgggagccggcacaggtggtgcacggccgtcgtcagctcgtgccgtgaggtgttgggttaagtcccgcaacgagcgcaacccctgcccctagttgccagcggttcggccgggcactctagggggactgccggcgacgagccggaggaaggaggggatgacgtcaggtactcgtgccccttatgccctgggcgacacacgcgctacaatgggcggtacaatgggttgcgaccccgcgagggggagccaatccccaaagccgccctcagttcggatcgcaggctgcaacccgcctgcgtgaagccggaatcgctagtaatcgcggatcagccacgccgcggtgaatacgttcccgggccttgtacacaccgcccgtcacgccacccgagtcgggggctcccgaagacacctaccccaacccgaaagggagggggggtgtcgagggagaacctggcgaggggggcgaagtcgtaacaaggtagccgtaccggaaggtgcggctggatcacctcctttcta

SEQ ID NO: 9786 - DNA, 1430 bp, Thermovenabulum gondwanense
  ref <308>: DATABASE ACCESSION NUMBER: NCBI ACCESSION: NZ_LOHZ01000016.1
  ref <309>: DATABASE ENTRY DATE: 2019-04-01
  ref <313>: RELEVANT RESIDUES IN SEQ ID NO: (1)..(1430)
aacttgagagtttgatcctggctcaggacgaacgctggcggcgtgcctaacacatgcaagtcgagcggaggtgttggaaggtgaaagccggaagacaccttagcggcggacgggtgagtaacacgtaggcaacctacccaccacacggggatagccctgggaaaccgggggtaatacccgatgactttattaagcgggtgcttaataaagaaaggcaggaatgcggtggtggatgggcctgcggcccatcagctagttggcgggataacagcccaccaaggcgacgacgggtagccggcctgagagggtggtcggccacactgggactgggacacggcccagactcctacgggaggcagcagtggggaatattgggcaatggggggaaccctgacccagcgacgccgcgtggaggaagaaggccttcgggttgtaaactcctgtcacctgggaagaagaggacggtaccaggggaggaagccccggctaactacgtgccagcagccgcggtaatacgtagggggcgagcgttgtccggaattactgggcgtaaagggcgtgtaggcggggcagcaagttgcgggtaaaaaaccagggctcaaccctgggggtgcctgcgaaactgctgttcttgagggcgggagaggagagtggaattcccggagtagcggtgaaatgcgtagataccgggaggaacaccagtggcgaaggcggctctctggaccgaccctgacgctgaggcgcgaaagccaggggagcgaacgggattagataccccggtagtcctggccgtaaacgatggtcactaggtgtgggtggtgataagccatccgtgccggagccaacgcaataagtgacccgcctggggagtacggccgcaaggttgaaactcaaaggaattgacgggggcccgcacaagcggtggagcatgtggtttaattcgaagcaacgcgaagaaccttaccaggccttgacatgcaggtagtagcgaaccgaaaggggagcgacgcttacgcaagtaagcgagcctgcacaggtggtgcatggttgtcgtcagctcgtgtcgtgagatgttgggttaagtcccgcaacgagcgcaacccctacacttagttgccagcacgggaggtgggcactctaagtgaactgccgccgacaaggcggaggaaggtggggatgacgtcaaatcatcatgccctttatggcctgggccacacacgtgctacaatggccggtacaacgggaggcgaaggtgcgaaccggagcgaagcccttaaagccggtctcagttcagattgcaggctgcaactcgcctgcatgaaggcggaatcgctagtaatcgcggatcagcatgccgcggtgaatacgttcccgggccttgtacacaccgcccgtcacaccatgggagttggcaacacccgaagccgggc

SEQ ID NO: 9787 - DNA, 1593 bp, Thermovibrio ammonificans
  ref <308>: DATABASE ACCESSION NUMBER: NCBI ACCESSION: NC_014926.1
  ref <309>: DATABASE ENTRY DATE: 2019-04-01
  ref <313>: RELEVANT RESIDUES IN SEQ ID NO: (1)..(1593)
ttccgctggagagtttgatcctggctcagcgcgaacgctgtcggcgtgcctaacacatgcaagtcgtggggcagcgggccggttccttcgggaaccggtgccggcgaccggcgaacgggtgagtaacgcgtgagcaacctaccccgaggagggggataacccggggaaacccgggctaataccccataagcgcacaggccgcatggcccgtgtgaaaagggtggcctctgcttcgcatgctgccgcctcgggatgggctcgcgtcccatcaggtagttggtggggtaacggcctaccaagcctacgacgggtagctggtctgagaggatggccagccacaccgggactgagacacggcccggactcctacgggaggcagcagtggggaatcttgggcaatgggcgcaagcctgacccagcgacgccgagtggaggatgaagcccttcggggtgtaaactcctgtcgccggggacgatgcgggcgggggtgaatagcccccgcccgtgacggtacccggagaggaagggacggctaactacgtgccagcagccgcggtaatacgtaggtcccgagcgttgcgcgaaattactgggcgtaaagtgcgcgtaggcgggccagtaagtcagaggtgaaagcccccggctcaaccggggaattgcctctgatactgctggcctagggtccggaagacgctggcggaattcccggtgtagcggtgaaatgcgtagatatcgggaggaacaccggtggcgaaggcggccagcgaggacggtaccgacactgaggcgcgaaagcgtggggagcaaaccggattagatacccgggtagtccacgctgtaaacgatgggtgctgggcgttgcaccctaaagggtgcagtgccgaagctaacgcgttaagcaccccgcctggggagtacggccgcaaggctgaaactcaaaggaatagacgggggcccgcacaagcggtggagcatgtggtttaattcaatgctacgcgaagaaccttaccagggcttgacatgccgggggtagccctgccgaaaggcagggtcgtggcccccttcgggggcccgacccggcacaggtggtacatggccgtcgtcagctcgtgccgtgaggtgttgggttaagtcccgcaacgagcgcaacccctgtccctagttgccagcgggtaatgccgggcacactagggagactgccggcgacaagccggaggaagggggggatgacgtcaggtcagtatgccccttacgccctgggctacacacgtgctacaatggccgggacagagggattgcgaagccgcgaggtggagcaaatctcagaaacccggtcccagttcggattgcaggctgcaactcgcctgcatgaagctggaatcgctagtaacggccggtcagctacacggccgtgaatacgttcccgggccttgtactcaccgcccgtcacaccccggaagctggctctaccagaagtccccgagccaacccccctctcggggggaggcaggggccgaaggtagggccggtgactggggtgaagtcgtaacaaggtagccgtaggagaacctgcggctggatcacctcctttta

SEQ ID NO: 9788 - DNA, 1589 bp, Thermovibrio guaymasensis
  ref <308>: DATABASE ACCESSION NUMBER: NCBI ACCESSION: NZ_RBIE01000008.1
  ref <309>: DATABASE ENTRY DATE: 2019-04-01
  ref <313>: RELEVANT RESIDUES IN SEQ ID NO: (1)..(1589)
ttcgctggagagtttgatcctggctcagcgcgaacgctgtcggcgtgcctaacacatgcaagtcgtggggcagcgggcgggctccttcgggagcccgtgccggcgaccggcgaacgggtgagtaacgcgtgagcaacctaccccgaggagggggataacccggggaaacccgggctaataccccataagcgcacggcccgcatgggctgtgtgaaaagggtggcctctgctttgcaagctgccgcctcgggatgggctcgcgtcccatcaggtagttggtgaggtaacggctcaccaagcctacgacgggtagccggcctgagagggtggccggccacaccgggactgagacacggcccggactcctacgggaggcagcagtggggaatcttgggcaatgggcgcaagcctgacccagcgacgccgagtggaggaagaagcccttcggggtgtaaactcctgtcgccggggacgatgcgggtaggggttaatagcctctacccgtgacggtacccggagaggaagggacggctaactacgtgccagcagccgcggtaatacgtaggtcccgagcgttgcgcgaaattactgggcgtaaagtgcgcgtaggcgggccagtaagtcagaggtgaaagcccccggctcaaccggggaattgcctctgatactgctggcctagggtccggaagacgctggcggaattcccggtgtagcggtgaaatgcgtagatatcgggaggaacaccggtggcgaaggcggccagcgaggacggtaccgacgctgaggcgcgaaagcgtggggagcgaaccggattagatacccgggtagtccacgctgtaaacgatgggtgctgggcgttgtgcccgatagggtgcagtgccgaaggtaacccgttaagcaccccgcctggggagtacggccgcaaggctgaaactcaaaggaatagacgggggcccgcacaagcggtggagcatgtggtttaattcaatgctacgcgaagaaccttaccagggcttgacatgccgggggtagccctgccgaaaggcagggtcgcggcccccttcggggggcccacccggcacaggtggtacatggccgtcgtcagctcgtgccgtgaggtgttgggttaagtcccgcaacgagcgcaacccctgtccctagttgccagcgggtaaagccgggcacactagggagactgccggcgataagccggaggaagggggggatgacgtcaggtcagtatgccccttacgccctgggctacacacgtgctacaatggccgggacagagggattgcgaagccgcgaggcggagcaaatctcagaaacccggtcccagttcggattgcaggctgcaactcgcctgcatgaagctggaatcgctagtaacggccggtcagctacacggccgtgaatacgttcccgggccttgtactcaccgcccgtcacaccccggaagctggctctaccagaagtccccgagctaacccccgcaagggggaggcaggggccgaaggtagggctggtgactggggtgaagtcgtaacaaggtagccgtaggagaacctgcggctggatcacctcctttt

SEQ ID NO: 9789 - DNA, 1540 bp, Thermovirga lienii
  ref <308>: DATABASE ACCESSION NUMBER: NCBI ACCESSION: NC_016148.1
  ref <309>: DATABASE ENTRY DATE: 2019-04-01
  ref <313>: RELEVANT RESIDUES IN SEQ ID NO: (1)..(1540)
tttttttggagagtttgatcctggctcaggacgaacgctggcggcgtgcctaacacatgcaagtcggacggggtgagttagtggaagctttcgggttgaagctgacttacctagtggcggacgggtgagtaacgcgtgaattacctaccctagggagggggataacgcctggaaacgggtgctaataccccataggccgggaggttaaagggaggaatctgccctaggatgggttcgcgtcctatcagctagttggtggggtaatggcctaccaaggcgaagacgggtagccggtctgagaggatgtacggccacactggaactgagacacggtccagactcctacgggaggcagcagtggggaatattgggcaatgggcgcaagcctgacccagcgacgccgcgtgagggaagaaggcctttgggttgtaaacctctgttgtacgggaagaaggcagtgacggtaccgtacgaggaagccccggcaaactacgtgccagcagccgcggtaatacgtagggggcgagcgttgtccggaattactgggcgtaaagggcgcgcaggcggatatgcaagtctgctgtgtaatgtcacggctcaaccgtgtcattgcggtggaaactgcatatctggagtactggagaggggagtggaattcccggtgtagcggtgaaatgcgtagatatcgggaggaacaccagtggcgaaggcggctctctggccagttactgacgctcatgcgcgaaagctgggggagcgaaccggattagatacccgggtagtcccagccgtaaacgatgaatgctaggtgtgggtgtcgtagggcatctgtgccgcagttaacgcgataagcattccgcctggggagtacggtcgcaagattgaaactcaaaggaattgacgggggcccgcacaagcggtggagcacgtggtttaattcgatgcaaaccgaagaaccttacctgggtttgacatgtacgtggtactgacctgaaaggggagggacccatacttcggtatgggagcgtacacaggtgctgcatggctgtcgtcagctcgtgtcgtgagatgttgggttaagtcccgcaacgagcgcaacccctgcatctagttgccaacgggtgaagctgggcactctagatggactgccggcgacaagccggaggaaggtggggatgacgtcaagtcatcatggcccttatgtccagggcgacacacgtgctacaatggccggtacagcgggaagcgaaggggagacctggagcggatctctgaaagccggtcccagttcggattgtagtctgcaactcgactacatgaagctggaatcgctagtaatcgcggatcagccaagccgcggtgaatacgttcccgggccttgtacacaccgcccgtcacaccacccgagttgggtgcacccgaagccggtggcctaacccttaaggggaggagccgtcgaaggtgtgcctggtaaggggggtgaagtcgtaacaaggtagccgtaccggaaggtgcggctggatcacctcctttctaagga

SEQ ID NO: 9790 - DNA, 1515 bp, Thermus scotoductus
  ref <308>: DATABASE ACCESSION NUMBER: NCBI ACCESSION: NZ_PEMW01000224.1
  ref <309>: DATABASE ENTRY DATE: 2019-04-01
  ref <313>: RELEVANT RESIDUES IN SEQ ID NO: (1)..(1515)
ttattggagagtttgatcctggctcagggtgaacgctggcggcgtgcctaagacatgcaagtcgagcggggcaggtttatacctgttcagcggcggacgggtgagtaacgcgtgggtgacctacccggaagaggcggacaacctggggaaacccaggctaatccgccatgtggtcctatcctgtggggtaggactaaaggggcgacccgcttccggatgggcccgcgtcccatcagctagttggtggggtaaaggcccaccaaggcgacgacgggtagccggtctgagaggatggccggccacaggggcactgagacacgggccccactcctacgggaggcagcagttaggaatcttccgcaatggacggaagtctgacggagcgacgccgcttggaggaggaagcccttcggggtgtaaactcctgaactggggacgaaagccccgtgtagggggatgacggtacccaggtaatagcgccggccaactccgtgccagcagccgcggtaatacggagggcgcgagcgttacccggatttactgggcgtaaagggcgtgtaggcggcctggggcgtcccatgtgaaaggccacggctcaaccgtggaggagcgtgggatacgctcaggctagagggtgggagagggtggtggaattcccggagtagcggtgaaatgcgcagataccgggaggaacgccgatggcgaaggcagccacctggtccacttctgacgctgaggcgcgaaagcgtggggagcaaaccggattagatacccgggtagtccacgccctaaacgatgcgcgctaggtctctgggtttatctgggggccgaagccaacgcgttaagcgcgccgcctggggagtacggccgcaaggctgaaactcaaaggaattgacgggggctcgcacaagcggtggagcatgtggtttaattcgaagcaacgcgaagaaccttaccaggccttgacatgctggggaacctgggtgaaagcctggggtgcccgtgagggagccccagcacaggtgctgcatggccgtcgtcagctcgtgtcgtgagatgttgggttaagtcccgcaacgagcgcaacccctgcccttagttgccagcgggttgggccgggcactctaaggggactgcctgcgaaagcaggaggaaggcggggacgacgtctggtcatcatggcccttacggcctgggcgacacacgtgctacaatgcccactacagagcgaggcgacccagtgatggggagcgaatcgcaaaaaggtgggcgtagttcggattggggtctgcaacccgaccccatgaagccggaatcgctagtaatcgcggatcagccatgccgcggtgaatacgttcccgggccttgtacacaccgcccgtcacgccatgggagcgggttctacccgaagtcgccgggagccttagggcaggcgccgagggtagggctcgtgactggggcgaagtcgtaacaaggtagctgtaccggaaggtgcggctggatcacctcctttct

SEQ ID NO: 9791 - DNA, 1516 bp, Thermus sp. L198
  ref <308>: DATABASE ACCESSION NUMBER: NCBI ACCESSION: NZ_QURO01000004.1
  ref <309>: DATABASE ENTRY DATE: 2019-04-01
  ref <313>: RELEVANT RESIDUES IN SEQ ID NO: (1)..(1516)
ttggagagtttgatcctggctcagggtgaacgctggcggcgtgcctaagacatgcaagtcgtgcgggccgtggggtttctcacggctagcggcggacgggtgagtaacgcgtgggtgacctacccggaagagggggacaacctggggaaacccaggctaatcccccatgtggacgcatcctgtggggtgcgttcaaagggcgttgcccgcttccggatgggcccgcgtcccatcagccagttggtggggtaaaggcccaccaaggcgacgacgggtagccggtctgagaggatggccggccacaggggcactgagacacgggccccactcctacgggaggcagcagttaggaatcttccgcaatgggcgcaagcctgacggagcgacgccgcttggaggaggaagcccttcggggtgtaaactcctgaacccgggacgaaatccccggagagggggctgacggtactggggtaatagcgccggccaactccgtgccagcagccgcggtaatacggagggcgcgagcgttacccggatttactgggcgtaaagggcgtgtaggcggtccagggcgtcccatgtgaaaggccacggctcaaccgtggaggagcgtgggatacgcttgggctagacggcgggagggggtggtggaattcccggagtagcggtgaaatgcgcagataccgggaggaacgccgatggcgaaggcagccacctggctcgttcgtgacgctgaggcgcgaaagcgtggggagcaaaccggattagatacccgggtagtccacgccctaaacgatgcgcgctaggtctctggggtatctgggggccgaagccaacgcgttaagcgcgccgcctggggagtacggccgcaaggctgaaactcaaaggaattgacgggggcccgcacaagcggtggagcatgtggtttaattcgaagcaacgcgaagaaccttaccaggccttgacatgctaggggacctgggtgaaagcctggggtgccccgtgaggggagccctagcacaggtgctgcatggccgtcgtcagctcgtgtcgtgagatgttgggttaagtcccgcaacgagcgcaacccctgccgttagttgccagcggtttggccgggcactctaacgggactgcctgcgaaagcgggaggaaggcggggacgacgtctggtcatcatggcccttacggcctgggcgacacacgtgctacaatgcccactacagagcgaggcgacctggtgacggggagcggatcgcggaaaggtgggcgtagttcggattggggtctgcaacccgaccccatgaaggcggaatcgctagtaatcgcggatcagccatgccgcggtgaatacgttcccgggccttgtacacaccgcccgtcacgccatgggagcgggttctacccgaagtcgctgggagccttagggcaggcgccgagggtagggctcgtgactggggcgaagtcgtaacaaggtagctgtaccggaaggtgcggctggatcacctcctttcta

SEQ ID NO: 9792 - DNA, 1522 bp, Thermus thermophilus
  ref <308>: DATABASE ACCESSION NUMBER: NCBI ACCESSION: NZ_LR027517.1
  ref <309>: DATABASE ENTRY DATE: 2019-04-01
  ref <313>: RELEVANT RESIDUES IN SEQ ID NO: (1)..(1522)
ttgttggagagtttgatcctggctcagggtgaacgctggcggcgtgcctaagacatgcaagtcgtgcgggccgcggggttttactccgtggtcagcggcggacgggtgagtaacgcgtgggtgacctacccggaagagggggacaacccggggaaactcgggctaatcccccatgtggacccgccccttggggtgtgtccaaagggctttgcccgcttccggatgggcccgcgtcccatcagctagttggtggggtaatggcccaccaaggcgacgacgggtagccggtctgagaggatggccggccacaggggcactgagacacgggccccactcctacgggaggcagcagttaggaatcttccgcaatgggcgcaagcctgacggagcgacgccgcttggaggaagaagcccttcggggtgtaaactcctgaacccgggacgaaacccccgacgaggggactgacggtaccggggtaatagcgccggccaactccgtgccagcagccgcggtaatacggagggcgcgagcgttacccggattcactgggcgtaaagggcgtgtaggcggcctggggcgtcccatgtgaaagaccacggctcaaccgtgggggagcgtgggatacgctcaggctagacggtgggagagggtggtggaattcccggagtagcggtgaaatgcgcagataccgggaggaacgccgatggcgaaggcagccacctggtccacccgtgacgctgaggcgcgaaagcgtggggagcaaaccggattagatacccgggtagtccacgccctaaacgatgcgcgctaggtctctgggtctcctgggggccgaagctaacgcgttaagcgcgccgcctggggagtacggccgcaaggctgaaactcaaaggaattgacgggggcccgcacaagcggtggagcatgtggtttaattcgaagcaacgcgaagaaccttaccaggccttgacatgctagggaacccgggtgaaagcctggggtgccccgcgaggggagccctagcacaggtgctgcatggccgtcgtcagctcgtgccgtgaggtgttgggttaagtcccgcaacgagcgcaacccccgccgttagttgccagcggttcggccgggcactctaacgggactgcccgcgaaagcgggaggaaggaggggacgacgtctggtcagcatggcccttacggcctgggcgacacacgtgctacaatgcccactacaaagcgaggccacccggcaacggggagctaatcgcaaaaaggtgggcccagttcggattggggtctgcaacccgaccccatgaagccggaatcgctagtaatcgcggatcagccatgccgcggtgaatacgttcccgggccttgtacacaccgcccgtcacgccatgggagcgggctctacccgaagtcgccgggagcctacgggcaggcgccgagggtagggcccgtgactggggcgaagtcgtaacaaggtagctgtaccggaaggtgcggctggatcacctcctttcta

SEQ ID NO: 9793 - DNA, 1534 bp, Thiocapsa rosea
  ref <308>: DATABASE ACCESSION NUMBER: NCBI ACCESSION: NZ_RBXL01000001.1
  ref <309>: DATABASE ENTRY DATE: 2019-04-01
  ref <313>: RELEVANT RESIDUES IN SEQ ID NO: (1)..(1534)
ttgaactgaagagtttgatcctggctcagattgaacgctggcggcatgcctaacacatgcaagtcgaacgcgaaagggctttggcccgagtagagtggcggacgggtgagtaatgcatgggaatccacctcgacgtgggggataacccggggaaactcgggctaataccgcatacgacctacgggtgaaagggggcttcggctctcgcgtcgagacgagctcatgtccgattagctagttggcggggtaaaggcccaccaaggcgacgatcggtagctggtctgagaggatgatcagccacactgggactgagacacggcccagactcctacgggaggcagcagtggggaatattggacaatgggcgcaagcctgatccagcaatgccgcgtgtgtgaagaaggcctgcgggttgtaaagcactttcagtggggaagaaacgcctgaggcgaatactctcgggctatgacgttacccacagaagaagcaccggctaactccgtgccagcagccgcggtaatacggagggtgcaagcgttaatcggaatcactgggcgtaaagcgcacgtaggcggcaacgtaagtcagatgtgaaagccccgggctcaacccgggaacggcatttgagactgcgtcgctcgagtctgagagaggggggtggaattccaggtgtagcggtgaaatgcgtagagatctggaggaacaccagtggcgaaggcggccccctggctcaagactgacgctgaggtgcgaaagcgtggggagcaaacaggattagataccctggtagtccacgccgtaaacgatgtcgactagccgtggggtccatttaagggcttcgtggcgcagctaacgcgataagtcgaccgcctggggagtacggccgcaaggttaaaactcaaaggaattgacgggggcccgcacaagcggtggagcatgtggtttaattcgatgcaacgcgaagaaccttaccagcccttgacatcctcggaatcctgcagagatgcgggagtgccttcgggagccgagagacaggtgctgcatggctgtcgtcagctcgtgtcgtgagatgttgggttaagtcccgtaacgagcgcaacccttgcccttagttgccagcgcgtgatggcgggaactctaaggggactgccggtgataaaccggaggaaggtggggatgacgtcaagtcatcatggcccttatgggctgggctacacacgtgctacaatggccggtacagagggttgccaacccgcgagggggagccaatctcagaaaaccggtcgtagtccggatcgcagtctgcaactcgactgcgtgaagtcggaatcgctagtaatcgcgaatcagcatgtcgcggtgaatacgttcccgggccttgtacacaccgcccgtcacaccatgggagttggttgcaccagaagcaggtagcttaaccttcgggagggcgcttgccacggtgtggtcaatgactggggtgaagtcgtaacaaggtagccgtaggggaacctgcggctggatcacctccttaaac

SEQ ID NO: 9794 - DNA, 1473 bp, Thioclava atlantica
  ref <308>: DATABASE ACCESSION NUMBER: NCBI ACCESSION: NZ_AQRC01000035.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcaggcctaacacatgcaagtcgagcgagatcttcggatctagcggcggacgggtgagtaacgcgtgggaacgtaccctttgctacggaatagccccgggaaactgggagtaataccgtataagcccttcgggggaaagatttttcggcaaaggatcggcccgcgttggattaggtagttggtggggtaacggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggactattaagtcaggggtgaaatcccggggctcaaccccggaactgcctctgatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttaccagagatggtttccttcagttcggctggatcagtgacaggtgctgcatggctgtcgtcagctcgtgtcgtgagatgttcggttaagtccggcaacgagcgcaacccacgtccttagttgccatcattcagttgggcactctagggaaactgccgatgataagtcggaggaaggtgtggatgacgtcaagtcctcatggcccttacgggttgggctacacacgtgctacaatggcagtgacaatgggataatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgaagatggtgcgccaacctgttcgcagggggcagctagccacggtaggatcagcgactggggtgaagtcgtaacaaggtagccgtaggggaacctgcggctggatcacctcctttctaa

SEQ ID NO: 9795 - DNA, 906 bp, Thioclava dalianensis
  ref <308>: DATABASE ACCESSION NUMBER: NCBI ACCESSION: NZ_FOVB01000039.1
  ref <309>: DATABASE ENTRY DATE: 2019-04-01
  ref <313>: RELEVANT RESIDUES IN SEQ ID NO: (1)..(906)
ggaactgcctctcatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttaccagagatggtttccttcagttcggctggatcagtgacaggtgctgcatggctgtcgtcagctcgtgtcgtgagatgttcggttaagtccggcaacgagcgcaacccacgtccttagttgccagcaggttaagctgggcactctagggaaactgccgatgataagtcggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgaagatggtgcgccaacctgttcgcagggggcagctagccacggtaggatcagcgactggggtgaagtcgtaacaaggtagccgtaggggaacctgcggctggatcacctcctttctaa

SEQ ID NO: 9796 - DNA, 1473 bp, Thioclava electrotropha
  ref <308>: DATABASE ACCESSION NUMBER: NCBI ACCESSION: NZ_NBXF01000035.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcaggcctaacacatgcaagtcgagcgagatcttcggatctagcggcggacgggtgagtaacgcgtggggatgtgccctttgctacggaatagtcccgggaaactgggtttaataccgtatgagcccttcgggggaaagatttatcggcaaaggatcaacccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgaacgatgaaggccttagggttgtaaagttctttcagctgggaagataatgacggtaccagcagaagaagccccggctaactccgtgccagcagccgcggtaatacggagggggctagcgttgttcggaattactgggcgtaaagcgcacgtaggcggactattaagtcaggggtgaaatcccggggctcaaccccggaactgcctctgatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttaccagagatggtttccttcagttcggctggatcagtgacaggtgctgcatggctgtcgtcagctcgtgtcgtgagatgttcggttaagtccggcaacgagcgcaacccacgtccttagttgccatcattcagttgggcactctagggaaactgccgatgataagtcggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgaagatggtgcgccaacctgttcgcagggggcagctagccacggtaggatcagcgactggggtgaagtcgtaacaaggtagccgtaggggaacctgcggctggatcacctcctttctaa

SEQ ID NO: 9797 - DNA, 1475 bp, Thioclava indica
  ref <308>: DATABASE ACCESSION NUMBER: NCBI ACCESSION: NZ_AUNB01000081.1
  ref <309>: DATABASE ENTRY DATE: 2019-04-01
  ref <313>: RELEVANT RESIDUES IN SEQ ID NO: (1)..(1475)
caacttgagagtttgatcctggctcagaacgaacgctggcggcaggcctaacacatgcaagtcgagcgagatcttcggatctagcggcggacgggttagtaacgcgtgggaatataccctttggtacggaatagcctcgggaaactgggagtaataccgtatgagcccttcgggggaaagatttatcgccaaaggattagcccgcgttggattagatagttggtggggtaatggcctaccaagtcgacgatccatagctggtttgagaggatgatcagcaacactgggactgagacacggcccagactcctacgggaggcagcagtggggaatcttagacaatgggcgcaagcctgatctagccatgccgcgtggacgatgaaggccttagggttgtaaagtcctttcagctgggaagataatgacggtaccagcagaagaagccccggctaactccgtgccagcagccgcggtaatacggagggggctagcgttgttcggaattactgggcgtaaagcgcacgtaggcggattattaagtgaggggtgaaatcccagggctcaaccctggaactgcctctcatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatgggtatcgcggtttccagagatggattccttcagttcggctggataccacacaggtgctgcatggctgtcgtcagctcgtgtcgtgagatgttcggttaagtccggcaacgagcgcaacccacgtccttagttgccagcaggttaagctgggcactctagggaaactgccgatgataagtcggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgaagatggtgcgccaacctgttcgcagggggcagctagccacggtaggatcagcgactggggtgaagtcgtaacaaggtagccgtaggggaacctgcggctggatcacctcctttctaa

SEQ ID NO: 9798 - DNA, 1472 bp, Thioclava pacifica
  ref <308>: DATABASE ACCESSION NUMBER: NCBI ACCESSION: NZ_AUND01000024.1
  ref <309>: DATABASE ENTRY DATE: 2019-04-01
  ref <313>: RELEVANT RESIDUES IN SEQ ID NO: (1)..(1472)
caacttgagagtttgatcctggctcagaacgaacgctggcggcaggcctaacacatgcaagtcgagcgagaccttcgggtctagcggcggacgggttagtaacgcgtgggaacgtgccctttgctacggaatagtcccgggaaactgggtttaataccgtatgtgcccttcgggggaaagatttatcggcaaaggatcggcccgcgttggattaggtagttggtggggtaacggcctaccaagccgacgatccatagctggtttgagaggatgatcagcaacactgggactgagacacggcccagactcctacgggaggcagcagtggggaatcttagacaatgggggaaaccctgatctagccatgccgcgtgagcgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggactattaagtcaggggtgaaatcccggggctcaaccccggaactgcctttgatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttagtggagacactttccttcagttcggctggatcagtgacaggtgctgcatggctgtcgtcagctcgtgtcgtgagatgttcggttaagtccggcaacgagcgcaacccacgtccttagttgccatcattcagttgggcactctagggaaactgccgatgataagtcggaggaaggtgtggatgacgtcaagtcctcatggcccttacgggttgggctacacacgtgctacaatggcagtgacaatgggttaatccctaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaagacggtgcgccaacctgttcgcagggggcagctggccacggtaggctcagcgactggggtgaagtcgtaacaaggtagccgtaggggaacctgcggctggatcacctcctttcta

SEQ ID NO: 9799 - DNA, 1473 bp, Thioclava sp. DLFJ4-1; identical to SEQ ID NO: 9796
  ref <308>: DATABASE ACCESSION NUMBER: NCBI ACCESSION: NZ_MPZT01000011.1
  ref <309>: DATABASE ENTRY DATE: 2019-04-01
  ref <313>: RELEVANT RESIDUES IN SEQ ID NO: (1)..(1473)

SEQ ID NO: 9800 - DNA, 1473 bp, Thioclava sp. DLFJ5-1
  ref <308>: DATABASE ACCESSION NUMBER: NCBI ACCESSION: NZ_MPZU01000012.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcaggcctaacacatgcaagtcgagcgaggtcttcggatctagcggcggacgggtgagtaacgcgtggggatgtgccctttgctacggaatagtcccgggaaactgggtttaataccgtatgagcccttcgggggaaagatttatcggcaaaggatcaacccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgaacgatgaaggccttagggttgtaaagttctttcagctgggaagataatgacggtaccagcagaagaagccccggctaactccgtgccagcagccgcggtaatacggagggggctagcgttgttcggaattactgggcgtaaagcgcacgtaggcggactattaagtcaggggtgaaatcccggggctcaaccccggaactgcctctgatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttaccagagatggtttccttcagttcggctggatcagtgacaggtgctgcatggctgtcgtcagctcgtgtcgtgagatgttcggttaagtccggcaacgagcgcaacccacgtccttagttgccatcattcagttgggcactctagggaaactgccgatgataagtcggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgaagatggtgcgccaacctgttcgcagggggcagctagccacggtaggatcagcgactggggtgaagtcgtaacaaggtagccgtaggggaacctgcggctggatcacctcctttctaa

SEQ ID NO: 9801 - DNA, 1473 bp, Thioclava sp. F28-4; identical to SEQ ID NO: 9796
  ref <308>: DATABASE ACCESSION NUMBER: NCBI ACCESSION: NZ_MPZQ01000037.1
  ref <309>: DATABASE ENTRY DATE: 2019-04-01
  ref <313>: RELEVANT RESIDUES IN SEQ ID NO: (1)..(1473)

SEQ ID NO: 9802 - DNA, 1473 bp, Thioclava sp. F36-6
  ref <308>: DATABASE ACCESSION NUMBER: NCBI ACCESSION: NZ_MPZX01000005.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcaggcctaacacatgcaagtcgagcgagatcttcggatctagcggcggacgggtgagtaacgcgtggggatgtgccctttgctacggaatagtcccgggaaactgggtttaataccgtatgagcccttcgggggaaagatttatcggcaaaggatcaacccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgaacgatgaaggccttagggttgtaaagttctttcagctgggaagataatgacggtaccagcagaagaagccccggctaactccgtgccagcagccgcggtaatacggagggggctagcgttgttcggaattactgggcgtaaagcgcacgtaggcggactattaagtcaggggtgaaatcccggggctcaaccccggaactgcctctgatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttaccagagatggtttccttcagttcggctggatcagtgacaggtgctgcatggctgtcgtcagctcgtgtcgtgagatgttcggttaagtccggcaacgagcgcaacccacgtccttagttgccagcattcagttgggcactctagggaaactgccgatgataagtcggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgaagatggtgcgccaacctgttcgcagggggcagctagccacggtaggatcagcgactggggtgaagtcgtaacaaggtagccgtaggggaacctgcggctggatcacctcctttctaa

SEQ ID NO: 9803 - DNA, 1473 bp, Thioclava sp. F36-7; identical to SEQ ID NO: 9796
  ref <308>: DATABASE ACCESSION NUMBER: NCBI ACCESSION: NZ_MPZR01000024.1
  ref <309>: DATABASE ENTRY DATE: 2019-04-01
  ref <313>: RELEVANT RESIDUES IN SEQ ID NO: (1)..(1473)
